US012642819B2

(12) United States Patent
Britton et al.

(10) Patent No.: US 12,642,819 B2
(45) Date of Patent: Jun. 2, 2026

(54) COMPOSITIONS AND METHODS FOR TREATING INFLAMMATORY BOWEL DISEASE

(71) Applicant: Icahn School of Medicine at Mount Sinai, New York, NY (US)

(72) Inventors: Graham J. Britton, New York, NY (US); Jeremiah J. Faith, New York, NY (US)

(73) Assignee: Icahn School of Medicine at Mount Sinai, New York, NY (US)

( * ) Notice: Subject to any disclaimer, the term of this patent is extended or adjusted under 35 U.S.C. 154(b) by 693 days.

(21) Appl. No.: 17/786,123

(22) PCT Filed: Dec. 19, 2020

(86) PCT No.: PCT/US2020/066262
§ 371 (c)(1),
(2) Date: Jun. 16, 2022

(87) PCT Pub. No.: WO2021/127598
PCT Pub. Date: Jun. 24, 2021

(65) Prior Publication Data
US 2023/0046662 A1     Feb. 16, 2023

Related U.S. Application Data

(60) Provisional application No. 62/951,167, filed on Dec. 20, 2019.

(51) Int. Cl.
| | |
|---|---|
| *A61K 35/74* | (2015.01) |
| *A61K 35/742* | (2015.01) |
| *A61K 35/744* | (2015.01) |
| *A61K 35/745* | (2015.01) |
| *A61K 35/747* | (2015.01) |
| *A61P 1/00* | (2006.01) |
| *G01N 33/50* | (2006.01) |
| *A61K 35/00* | (2006.01) |

(52) U.S. Cl.
CPC ............ *A61K 35/74* (2013.01); *A61K 35/742* (2013.01); *A61K 35/744* (2013.01); *A61K 35/745* (2013.01); *A61K 35/747* (2013.01); *A61P 1/00* (2018.01); *G01N 33/5091* (2013.01); *A61K 2035/115* (2013.01)

(58) Field of Classification Search
CPC .... A61K 35/74; A61K 35/742; A61K 35/744; A61K 35/745; A61K 35/747; A61K 2035/115
See application file for complete search history.

(56) References Cited

FOREIGN PATENT DOCUMENTS

| | | |
|---|---|---|
| CN | 112739376 | 4/2021 |
| EP | 3 895 710 | 10/2021 |
| JP | 2013-537531 | 10/2013 |
| JP | 2014-507481 | 3/2014 |
| WO | WO 2016/209806 | 12/2016 |
| WO | WO 2019/209640 | 10/2019 |
| WO | WO 2019/227085 | 11/2019 |

OTHER PUBLICATIONS

H. Kwon, C. Lee, J. So, C. Chae, J. Hwang, A. Sahoo, J.H. Nam, J.H. Rhee, K. Hwang, & S. Im, Generation of regulatory dendritic cells and CD4+Foxp3+ T cells by probiotics administration suppresses immune disorders, Proc. Natl. Acad. Sci. U.S.A. 107 (5) 2159-2164, (2010). (Year: 2010).*
Ozerlat, I. ROR blockers inhibit TH17 cells. Nat Rev Neurol 7, 303 (2011). https://doi.org/10.1038/nrneurol.2011.75 (Year: 2011).*
Guo NH, Fu X, Zi FM, Song Y, Wang S, Cheng J. The potential therapeutic benefit of resveratrol on Th17/Treg imbalance in immune thrombocytopenia purpura. Int Immunopharmacol. Aug. 2019;73:181-192. doi: 10.1016/j.intimp.2019.04.061. Epub May 16, 2019. PMID: 31102993. (Year: 2019).*
IPRP, "International Preliminary Report of Patentability in PCT/US20/066262", Jun. 30, 2022, 10 Pages.
"International Search Report and Written Opinion in International Application No. PCT/US2020/066262, filed Dec. 19, 2020", May 6, 2021, 18 pages.
Britton, Contijoch EJ, et al., "Microbiotas from Humans with Inflammatory Bowel Disease Alter the Balance of Gut TH17 and RORgammat+ Regulatory T Cells and Exacerbate Colitis in Mice Immunity", Jan. 15, 2019; vol. 50, No. 1, pp. 212-224, p. 213, col. 1, para 3; p. 220, col. 2, para 1; Fig. 3; Fig. 5A; p. e3, para 2; p. 216, col. 2, para 1; p. e3, para 1, p. 219, col. 2, para 2; p. 212, summary; Table 1.
"Japanese Office Action mailed Jul. 31, 2023 in JP Application No. 2022-538098", 16 pages.
"Office Action in Canadian Application No. 3162387", Jun. 14, 2023, 5 pages.
Britton, et al., "Microbiotas from Humans with Inflammatory Bowel Disease Alter the Balance of Gut Th17 and RORγt+ Regulatory T Cells and Exacerbate Colitis in Mice", Immunity, Jan. 15, 2019, 50, 212-224.
"Communication Pursuant to Rules 70(2) and 70a(2) EPC in EP Application No. 20904321.6", Jan. 9, 2024, 1.
"Examination Report in Australian Application No. 2020407659", Mar. 13, 2024, 4 pages.
"Extended European Search Report in EP Application No. 20904231.6", Dec. 22, 2023, 11 pages.
"First Office Action In Chinese Application No. 202080097355.0", Jan. 20, 2025, 42 pages.
B-H Yang, et al., "Foxp3+ T cells expressing ROR[gamma]t represent a stable regulatory T-cell effector lineage with enhanced suppressive capacity during intestinal inflammation", Mucosal Immunology, vol. 9, No. 2, Aug. 26, 2015 (Aug. 26, 2015), pp. 444-457, XP055706437, New York, ISSN: 1933-0219, DOI: 10.1038/mi.2015.74, 14 pages.

(Continued)

*Primary Examiner* — Melenie L Gordon
*Assistant Examiner* — John Paul Selwanes
(74) *Attorney, Agent, or Firm* — IP Spring

(57) ABSTRACT

The present invention provides methods of diagnosing, treating, and monitoring the progression of inflammatory bowel disease in a subject, including, for example, by monitoring RORγt⁺Th or RORγt⁺Treg cell levels and treating the subject accordingly.

6 Claims, 28 Drawing Sheets

Specification includes a Sequence Listing.

(56)                    References Cited

OTHER PUBLICATIONS

De Jong Renske J., et al., "Defining Dysbiosis in Inflammatory Bowel Disease", Immunity, vol. 50, No. 1, Jan. 1, 2019 (Jan. 1, 2019), pp. 8-10, XP93111819, Amsterdam, NL ISSN: 1074-7613, DOI: 10.1016/j.immuni.2018.12.028, 3 pages.

Galvez Julio, et al., "Role of Th17 Cells in the Pathogenesis of Human IBD", ISRN Inflammation, vol. 2014, Mar. 25, 2014 (Mar. 25, 2014), pp. 1-14, XP93111346, ISSN: 2090-8695, DOI: 10.1155/2014/928461 Retrieved from the Internet: URL:http://downloads.hindawi.com/archive/2014/928461.XML>, 14 pages.

Graham J. Britton, et al., "Inflammatory bowel disease microbiotas alter gut CI) 4 T-1 cell homeostasis and drive colitis in mice", BIORXIV, Mar. 6, 2018 (Mar. 6, 2018), pp. 1-18, XP55648866, DOI: 10.1101/276774, 18 pages.

Graham J. Britton, et al., "Defined microbiota transplant restores Th17/ROR[gamma]t + regulatory T cell balance in mice colonized with inflammatory bowel disease microbiotas", Proceedings of the National Academy of Sciences, vol. 117, No. 35, Aug. 18, 2020 (Aug. 18, 2020), pp. 21536-21545, XP93111340, ISSN: 0027-8424, DOI: 10.1073/pnas.1922189117, 10 pages.

M. Lochner, et al., "Restricted Microbiota and Absence of Cognate TCR Antigen Leads to an Unbalanced Generation of Th17 Cells", The Journal of Immunology, vol. 186, No. 3, Feb. 1, 2011 (Feb. 1, 2011), pp. 1531-1537, XP055341493, US ISSN: 0022-1767, DOI: 10.4049/jimmunol.1001723, 8 pages.

"Communication pursuant to Article 94(3) EPC in EP Application No. 20904231.6", Mar. 24, 2025, 4 pages.

* cited by examiner

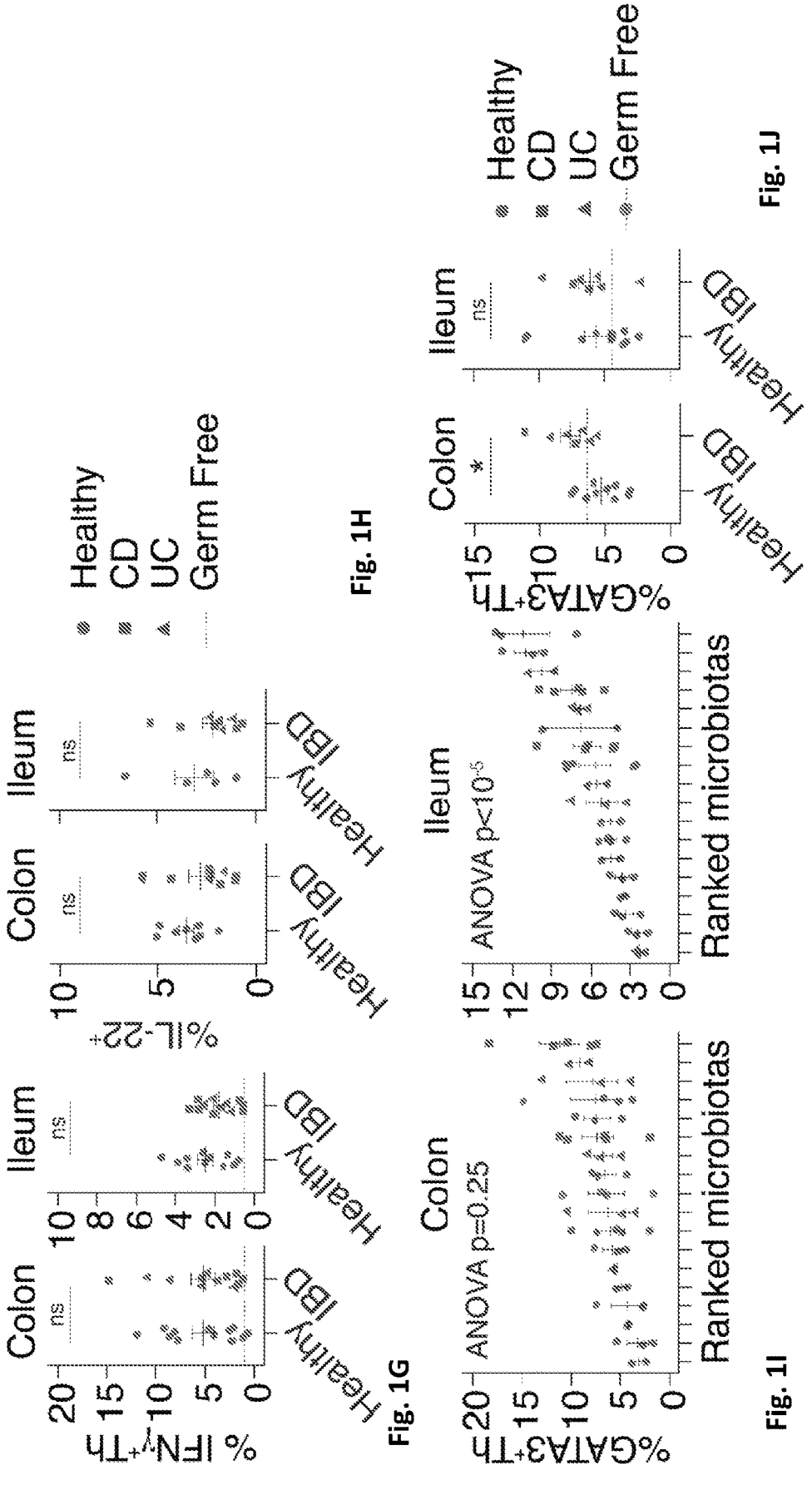

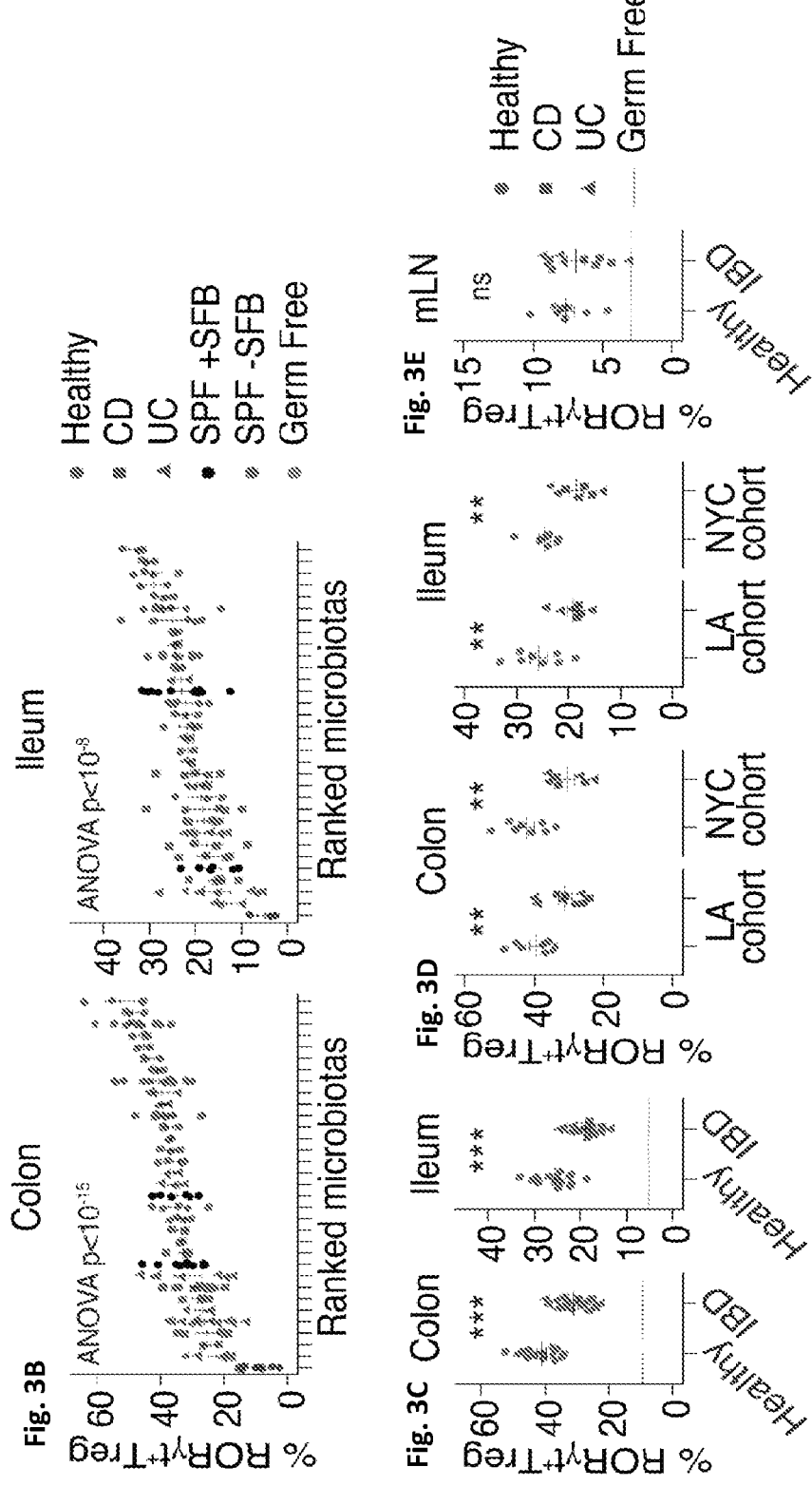

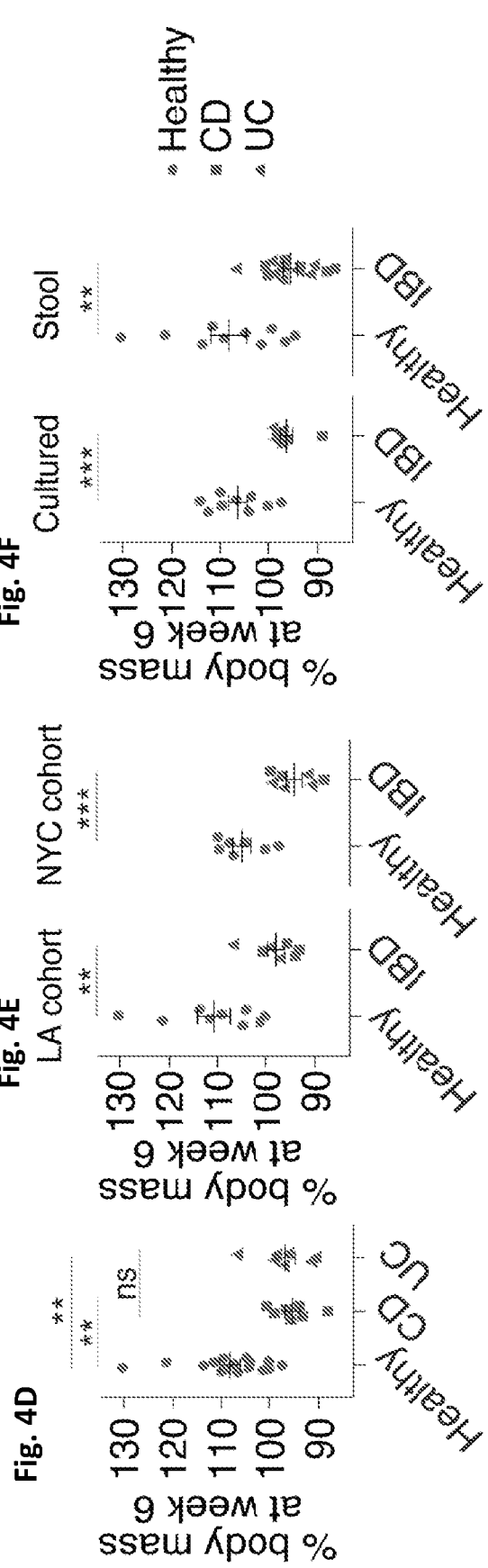

RORγt+ Th          AUC: 0.71

RORγt+ Treg          AUC: 0.92

TCT week 6          AUC: 0.93

RORγt+ Treg
+
TCT week 6          AUC: 0.95

| Microbiota | T cell donor |
|------------|--------------|
| ● HD2021 | FoxP3$^{Cre}$ x RORgt$^{FL/WT}$ |
| ● HD2021 | FoxP3$^{Cre}$ x RORgt$^{FL/FL}$ |
| ● UC1024 | FoxP3$^{Cre}$ x RORgt$^{FL/WT}$ |

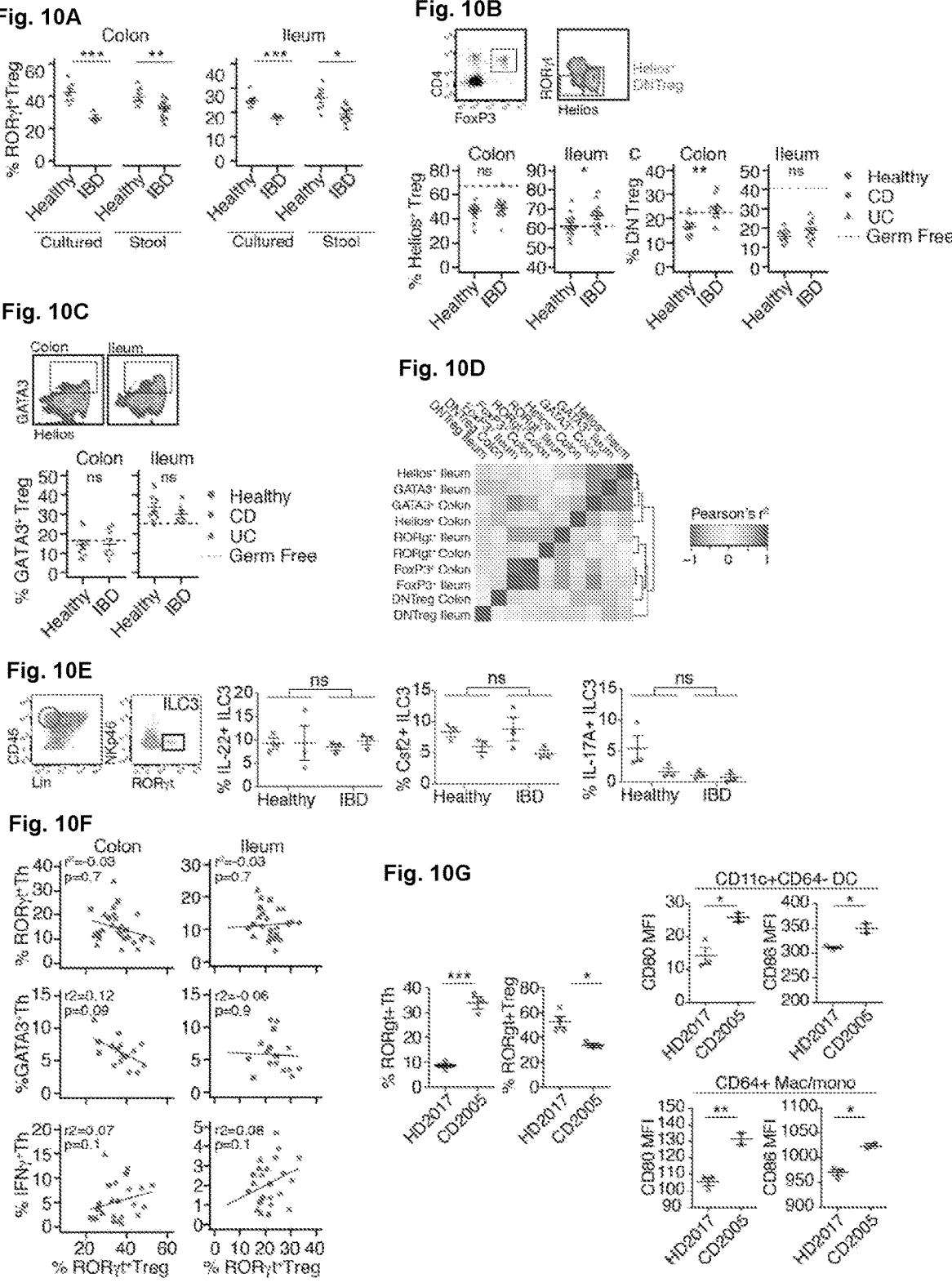

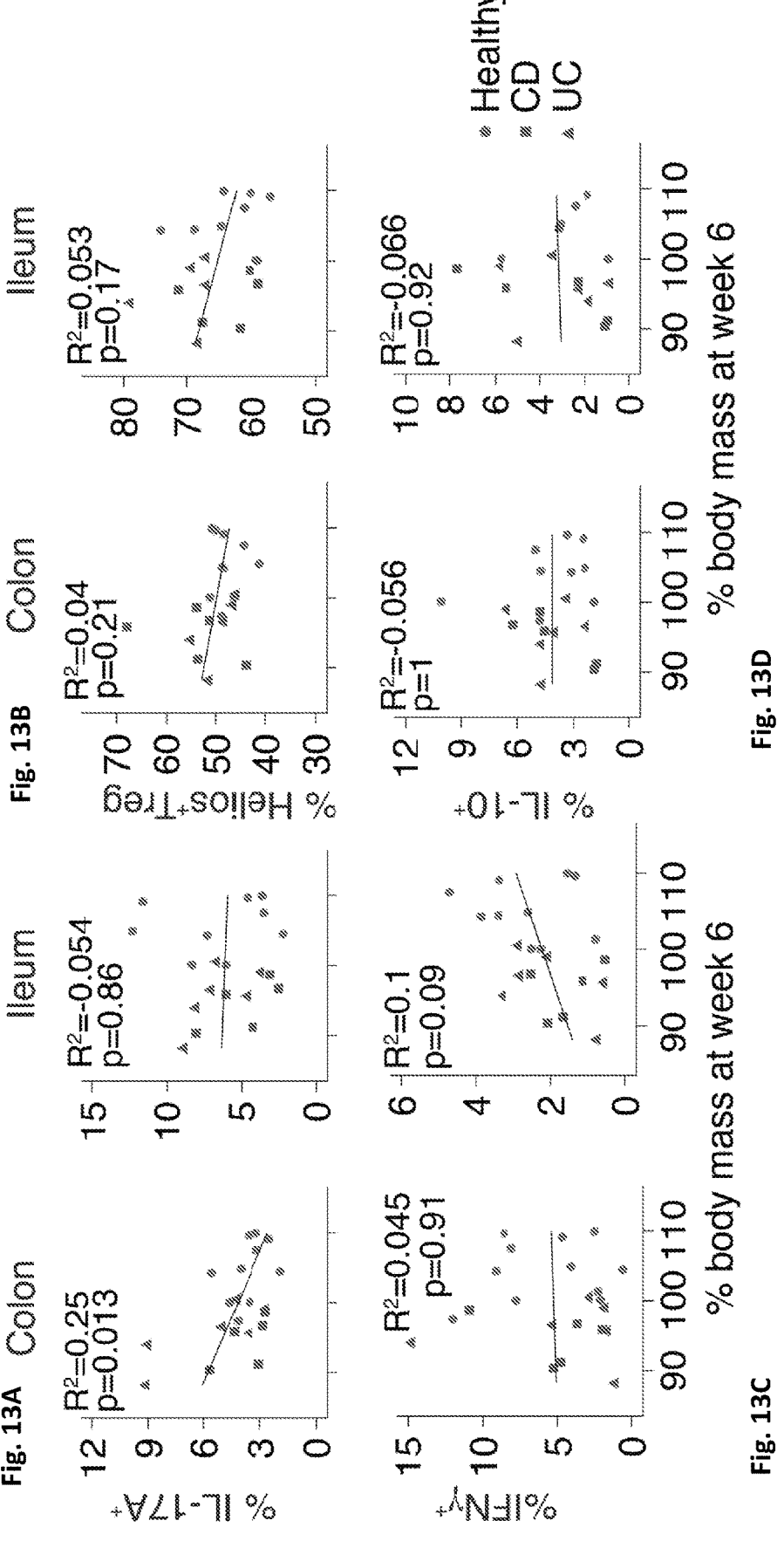

COMPOSITIONS AND METHODS FOR TREATING INFLAMMATORY BOWEL DISEASE

STATEMENT REGARDING FEDERALLY SPONSORED RESEARCH

This invention was made with government support under NIGMS GM108505 awarded by NIH. The government has certain rights in the invention.

SEQUENCE LISTING

The instant application contains a "lengthy" Sequence Listing which has been submitted via CD-R in lieu of a printed paper copy, and is hereby incorporated by reference in its entirety. Said CD-R, recorded on Jun. 14, 2022, are labeled "CRF", "Copy 1" and "Copy 2", respectively, and each contains only one identical 280,467,694 bytes file (MS-0006-01-US-NP_SL.txt), which file was created on Dec. 17, 2019.

RELATED APPLICATIONS

This application is a § 371 national stage of PCT International Application No. PCT/US20/66262, filed Dec. 19, 2020, which claims the benefit of U.S. Provisional Patent Application Ser. No. 62/951,167, filed Dec. 20, 2019, which is encorporated by reference in its entirety.

BACKGROUND

The mammalian gastrointestinal (GI) tract harbors a diverse microbial community that is usually maintained in symbiotic balance. Interactions between microbes within the microbial populations, and between the microbes and the host, affect both the host and the internal microbial community. For example, a majority of the mammalian immune system is directed at the GI tract. This may affect the internal microbial community structure, by eliminating some microbes and enabling the expansion of others. Even the host diet shapes the GI microbial community often by introducing new microbes, benefitting some microbes, or inhibiting others.

A healthy GI microbiome also benefits the host. It can render the host resistant to colonization by a broad spectrum of pathogens, provide immune stimulation, promote maintenance of a healthy gut epithelium, and provide essential nutrients such as vitamin K for absorption. In some individuals, this symbiotic balance is disrupted. This state can lead to disruption of microbial functions and lead to increased susceptibility to pathogens, induction of inflammatory signaling cascades that result in autoimmunity, and disruption of nutrient absorption. Consequently, the GI microbiome is a significant element in the pathogenesis of many diseases and disorders. Some patients become more susceptible to pathogenic infections after the use of broad-spectrum antibiotics that disrupt the normal intestinal microbiota flora. Many of these diseases and disorders, such as inflammatory bowel disease (IBD) are chronic conditions that significantly decrease a patient's quality of life and can be ultimately fatal.

IBD describes a variety of intestinal disorders, including Crohn's disease (CD) and ulcerative colitis (UC), which are all characterized by dysregulated GI immune responses and localized inflammatory signals in affected patients. Numerous animal models suggest the microbial strains that constitute the gut microbiota play a crucial role in shaping the immune system, consequentially influencing host susceptibility to autoimmunity, inflammatory disease, and infection. See, e.g., K. Atarashi et al. (2017) *Science* 358, 359-365; K. Atarashi et al. (2011) *Science* 331, 337-341; Ivanov, II, et al. (2009) *Cell* 139, 485-498; A. Chudnovskiy et al. (2016) *Cell* 167, 444-456 e414. And genetic defects in microbial handling are implicated in disease. L. Jostins, et al. (2012) *Nature* 491, 119-124.

Therefore, interventions targeting the microbiota are potentially a path to treatment of IBD. P. Moayyedi, et al. (2015) *Gastroenterology* 149, 102-109; S. Paramsothy, et al. (2017), *Lancet* 389, 1218-1228. Recent research has focused on the induction of certain immune cell populations in the GI as markers of IBD. Some studies have correlated specific bacteria with differentiation of Th17 cells in mouse models of IBD. Ivanov, II, et al., (2008) *Cell Host Microbe,* 4 (4): 337; and Tan, T. G., et al., (2016) *PNAS USA,* 113(50): E8141. Another shows that IgA coated *E. coli* induce inflammation and Th17 accumulation in the gut of Crohn's disease patients. Viladomiu, M., et al., (2017) *Sci Transl Med,* 9(376). An antibody that inhibits IL-23, a cytokine required for differentiation of Th17 cells, leads to clinical improvement in individuals with Crohn's disease. Sands, et al. (2017) *Gastroenterology* 153(1):77-86. One study has also shown that induction of Th17 cells by gut microbiota provide protection from gut pathogens. Ivanov, II, et al., (2009) *Cell* 139(3): 485.

While these studies provide suggestions that one immune signal may be correlated with IBD in affected individuals, there is a need in the art for improved methods for detecting, staging, and treating subjects with IBD based on multiple immune markers associated with IBD. There is also a need for identifying therapeutic agents for modulating the effects of these immunogenic signals in the GI of individuals afflicted with IBD. The present disclosure fulfills these needs by identifying for the first time multiple microbiota-induced T-cell populations that are correlated with IBD disease and associated with its progression.

SUMMARY OF THE DISCLOSURE

The present disclosure relates generally to diagnosing, treating, and monitoring the progression of inflammatory bowel disease in a subject, including, for example, by monitoring RORγt⁺Th or RORγt⁺Treg cell levels and treating a subject accordingly. The present disclosure also relates to a method for inhibiting proliferation or accumulation of RORγt⁺Th cells or modulating an immune or inflammatory response. The present disclosure also relates to a method for inducing proliferation or accumulation of RORγt⁺Treg cells or modulating an immune or inflammatory response. Such methods may include reduction of inflammation caused by RORγt⁺Th cells or enhancing the protective effect of RORγt⁺Treg cells in the gastrointestinal tract via a drug, vaccine, probiotic, or other means. Diagnosis and monitoring can be achieved by tracking biomarkers in the subject that are associated with the specific microbial strain identified.

BRIEF DESCRIPTION OF THE FIGURES

FIG. 1A-J. The figures show that IBD-associated microbiotas enhance induction of gut RORγt+ Th compared to healthy donor microbiotas in gnotobiotic mice.

FIG. 3A-G. The figures show that healthy donor microbiotas specifically enhance induction of gut RORγt+ Treg compared to IBD-associated microbiotas.

FIG. 4A-I. The figures show that IBD-associated microbiotas transmit enhanced colitis severity to susceptible mice.

FIG. 10A-G. The figures show that healthy donor microbiotas specifically enhance induction of gut RORγt+Treg compared to IBD-associated microbiotas.

FIG. 13A-D. The figures show a relationship between homeostatically-induced T cell populations and colitis severity.

DEFINITIONS

Figures 1A, 1B:
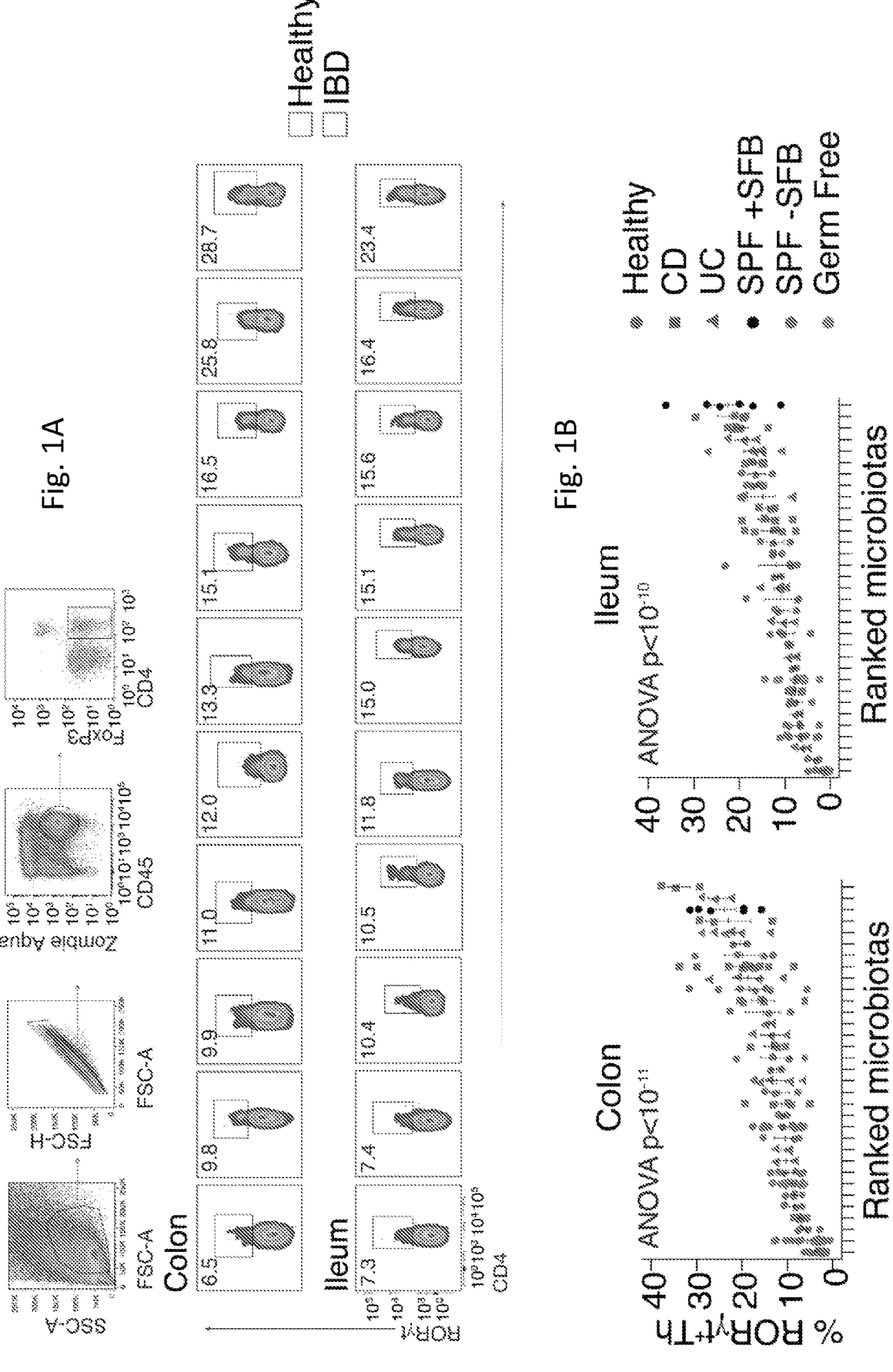

Unless otherwise defined herein, scientific and technical terms used in connection with the present disclosure shall have the meanings that are commonly understood by those of ordinary skill in the art. The meaning and scope of the terms should be clear, however, in the event of any latent ambiguity, definitions provided herein take precedent over any dictionary or extrinsic definition. Further, unless otherwise required by context, singular terms shall include pluralities and plural terms shall include the singular.

As used herein, the terms "comprising" (and any form of comprising, such as "comprise," "comprises," and "comprised"), "having" (and any form of having, such as "have" and "has"), "including" (and any form of including, such as "includes" and "include"), or "containing" (and any form of containing, such as "contains" and "contain"), are inclusive or open-ended and do not exclude additional, unrecited elements or method steps.

The indefinite articles "a" and "an," as used herein in the specification and in the claims, unless clearly indicated to the contrary, should be understood to mean "at least one." The phrase "and/or," as used herein in the specification and in the claims, should be understood to mean "either or both" of the elements so conjoined, i.e., elements that are conjunctively present in some cases and disjunctively present in other cases. Other elements may optionally be present other than the elements specifically identified by the "and/or"

clause, whether related or unrelated to those elements specifically identified unless clearly indicated to the contrary. Thus, as a non-limiting example, a reference to "A and/or B," when used in conjunction with open-ended language such as "comprising" can refer, in one embodiment, to A without B (optionally including elements other than B); in another embodiment, to B without A (optionally including elements other than A); in yet another embodiment, to both A and B (optionally including other elements); etc.

As used herein in the specification and in the claims, the term "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, "either," "one of," "only one of," or "exactly one of" "Consisting essentially of," when used in the claims, shall have its ordinary meaning as used in the field of patent law.

The term "about" is used herein to mean within the typical ranges of tolerances in the art. For example, "about" can be understood as about 2 standard deviations from the mean. According to certain embodiments, when referring to a measurable value such as an amount and the like, "about" is meant to encompass variations of ±20%, ±10%, ±5%, ±1%, ±0.9%, ±0.8%, ±0.7%, ±0.6%, ±0.5%, ±0.4%, ±0.3%, ±0.2% or ±0.1% from the specified value as such variations are appropriate to perform the disclosed methods. When "about" is present before a series of numbers or a range, it is understood that "about" can modify each of the numbers in the series or range.

As used herein, the term "individual" in the present disclosure is not particularly limited, and examples thereof may include humans, mice, rats, cattle, horses, pigs, sheep, monkeys, dogs, and cats.

As used herein, the term "therapeutic composition" according to the present disclosure may be in the form of a vaccine, adjuvant, biological, pharmaceutical composition, probiotic, food, beverage, fecal transplant, complex microbial or fecal sample, bacterial strain, mixture of bacterial strains, a reagent used in an animal model, or a combination of such ingredients. The vaccine, adjuvant, biological, pharmaceutical composition, probiotic, food, beverage, or reagent, or combinatorial product can have the effect of reducing or eliminating IBD in a subject. The therapeutic compositions according to the present disclosure can also have the effect of stimulating or enhancing the differentiation, accumulation, or proliferation of RORγt⁺Treg cells or of reducing the differentiation, accumulation, or proliferation of RORγt⁺Th cells in a subject or of stimulating the immune response in a subject. Administration of such therapeutic compositions may be oral, buccal, parenteral, rectal, or via fecal transplantation.

The term "IBD" in the present disclosure includes gastrointestinal disorders such as inflammatory bowel disease (IBD), ulcerative colitis, and Crohn's disease.

As used herein, the term "RORγt⁺Th" means CD4⁺ αβ T cells that are RORγt positive and FoxP3 negative.

As used herein, the term "RORγt⁺Treg cells" means CD4⁺ αβ T cells that co-express FoxP3 and RORγt markers. They may also be identified by co-expression of FoxP3 and Neuropilin 1.

As used herein, the phrase "reducing or eliminating differentiation, accumulation, or proliferation of RORγt⁺Th cells" in the present disclosure includes an effect of reducing or inhibiting the differentiation of immature T cells into RORγt⁺Th cells, which differentiation leads to the proliferation or the accumulation of RORγt⁺Th cells. In addition, the meaning of the "reducing or eliminating differentiation, accumulation, or proliferation of RORγt⁺Th cells" in the present disclosure includes in-vivo effects, in vitro effects, and ex vivo effects. Accordingly, all of the following effects are included: reducing or inhibiting in vivo proliferation or accumulation of RORγt⁺Th cells in the gut through administration or ingestion of a therapeutic composition that inhibits IBD; reducing or inhibiting proliferation or accumulation of RORγt⁺Th cells by preventing a physiologically active substance to act on cultured RORγt⁺Th cells; and reducing or inhibiting proliferation or accumulation of RORγt⁺Th cells that are collected from a living organism and that are intended to be subsequently reintroduced into that organism or introduced into another organism, by preventing a physiologically active substance from acting on the RORγt⁺Th cells.

As used herein, the phrase "stimulating or enhancing the differentiation, accumulation, or proliferation of RORγt⁺ Treg cells" in the present disclosure includes an effect of increasing or stimulating the differentiation of immature T cells into RORγt⁺Treg cells, which differentiation leads to the proliferation or the accumulation of RORγt⁺Treg cells. In addition, the meaning of the "stimulating or enhancing the differentiation, accumulation, or proliferation of RORγt⁺ Treg cells" in the present disclosure includes in-vivo effects, in vitro effects, and ex vivo effects. Accordingly, all of the following effects are included: stimulating or enhancing in vivo proliferation or accumulation of RORγt⁺Treg cells in the gut through administration or ingestion of a therapeutic composition that inhibits IBD; increasing or enhancing proliferation or accumulation of RORγt⁺Treg cells by allowing or enhancing a physiologically active substance to act on cultured RORγt⁺Treg cells; and increasing or enhancing proliferation or accumulation of RORγt⁺Treg cells that are collected from a living organism and that are intended to be subsequently reintroduced into that organism or introduced into another organism, by allowing or enhancing a physiologically active substance to act on the RORγt⁺Treg cells.

DETAILED DESCRIPTION

In the following description, reference is made to certain formulations and specific embodiments that form a part hereof. The illustrative embodiments described in the detailed description and claims are not meant to be limiting. Other embodiments may be utilized, and other changes may be made, without departing from the scope of the present subject matter. Aspects of the present disclosure, can be arranged, substituted, combined, separated, and designed in a wide variety of different configurations, all of which are contemplated herein.

References in the specification to "one embodiment", "an embodiment", "an example embodiment" or "some embodiments," etc. indicate that the embodiments described may include a particular feature or characteristic, but every embodiment may not necessarily include the particular feature, structure, or characteristic. Moreover, such phrases are not necessarily referring to the same embodiment. Further, when a particular feature, structure, or characteristic is described in connection with an embodiment, such feature, structure, or characteristic may be achieved in connection with other embodiments whether or not explicitly described.

The present disclosure identifies for the first time multiple immunogenic cell types that can serve as markers for IBD. One aspect of the present disclosure provides a specific T-cell marker that is positively correlated with IBD. Another aspect of the present disclosure provides a specific T-cell marker that is inversely correlated with IBD.

One aspect of the present disclosure provides biological markers for staging or tracking IBD. Another aspect of the present disclosure provides a biological marker and a method for treating IBD. Another aspect of the present disclosure provides a method of screening for compositions and methods to treat or prevent IBD.

One aspect of the present disclosure provides a therapeutic composition for modulating an immune response in a subject. Another aspect of the present disclosure provides a method for treating or preventing at least one disease or condition selected from infectious diseases, cancer, and autoimmune diseases.

The disclosure provides a method in which the absolute amount or the ratio of RORγt⁺Th cell levels in the GI and gut lymph nodes of an individual with IBD is determined and can be compared with the baseline value of the amount of RORγt⁺Th cell levels in the GI of a healthy individual to provide an IBD diagnosis, prognosis, or treatment regimen.

The disclosure provides a method in which the absolute amount or the ratio of RORγt⁺Treg cell levels in the GI and gut lymph nodes of an individual with IBD is determined and can be compared with the baseline value of the amount of RORγt⁺Treg cell levels in the GI of a healthy individual to provide an IBD diagnosis, prognosis, or treatment regimen.

In one embodiment, the disclosure provides a method in which the absolute amount or the ratio of RORγt⁺Th cell levels in the GI and gut lymph nodes of an individual with IBD is determined, and, when a therapeutically active composition is administered to the individual that reduces the ratio or the absolute value of the RORγt⁺Th cell levels in comparison with a base line value in a healthy individual, it is determined that the therapeutically active composition is effective in treating IBD.

In one embodiment, the disclosure provides a method in which the absolute amount or the ratio of RORγt⁺Treg cell levels in the GI and gut lymph nodes of an individual with IBD is determined, and when a therapeutically active composition is administered to the individual that increases the ratio or the absolute value of the RORγt⁺Treg cell levels in comparison with a base line value in a healthy individual, it is determined that the therapeutically active composition is effective in treating IBD.

In one embodiment, the disclosure provides a method in which the absolute amount or the ratio of RORγt⁺Th cell levels and RORγt⁺Treg cell levels in the GI and gut lymph nodes of an individual with IBD is determined, and when a therapeutically active composition is administered to the individual that reduces the ratio or the absolute value of the RORγt⁺Th cell levels or increases the ratio or the absolute value of the RORγt⁺Treg cell levels in comparison with a base line value in a healthy individual, it is determined that the therapeutically active composition is effective in treating IBD.

In one embodiment, the disclosure provides a method in which the absolute amount or the ratio of RORγt⁺Th cell levels and RORγt⁺Treg cell levels in the GI and gut lymph nodes of an individual with IBD is determined, and when a therapeutically active composition is administered to the individual that reduces the ratio or the absolute value of the RORγt⁺Th cell levels and increases the ratio or the absolute value of the RORγt⁺Treg cell levels in comparison with a base line value in a healthy individual, it is determined that the therapeutically active composition is effective in treating IBD.

In one embodiment, the method further comprises measuring the levels of RORγt⁺Th cell levels in the GI and gut lymph nodes of the subject after administration of a therapeutic composition, wherein a decrease in the percentage or absolute number of RORγt⁺Th cell levels in the GI of the subject after administration of the therapeutic composition relative to levels prior to the administration is a positive indicator of enhanced immunosuppression (or immunoregulation). The measurement of the RORγt⁺Th cell levels in the subject's GI can be made with techniques known in the art, such as flow cytometry, immunohistochemistry, or immunofluorescence.

In one embodiment, the method further comprises measuring the levels of RORγt⁺Treg cell levels in the GI and gut lymph nodes of the subject after administration of a therapeutic composition, wherein a decrease in the percentage or absolute number of RORγt⁺Treg cell levels in the GI of the subject after administration of the therapeutic composition relative to levels prior to the administration is a positive indicator of enhanced immunosuppression (or immunoregulation). The measurement of the RORγt⁺Th cell levels in the subject's GI can be made with techniques known in the art, such as flow cytometry, immunohistochemistry, or immunofluorescence.

One embodiment provides a method for diagnosing IBD in a patient by: (a) obtaining a sample from a patient exhibiting symptoms associated with IBD; (b) incubating the sample in a microbe free mammal or in-vitro immune environment; (c) contacting the sample with an antibody that binds to RORγt⁺Th cells; (d) detecting binding of the antibody with RORγt⁺Th cells in the sample; and (e) predicting the presence or assessing status of IBD when the level of RORγt⁺Th cells in the patient is higher than a predetermined level of RORγt⁺Th cells.

One embodiment provides a method for diagnosing IBD in a patient by: (a) obtaining a sample from a patient exhibiting symptoms associated with IBD; (b) contacting the sample with an antibody that binds to RORγt⁺Treg cells; (d) detecting binding of the antibody with RORγt⁺Treg cells in the sample; and (e) predicting the presence or assessing status of IBD when the level of RORγt⁺Treg cells in the patient is higher than a predetermined level of RORγt⁺Treg cells.

One embodiment provides a method for diagnosing IBD in a patient by: (a) obtaining a sample from a patient exhibiting symptoms associated with IBD; (b) incubating the sample in microbe free mammal or in-vitro immune environment; (c) detecting the presence of a RORγt⁺Th cell specific nucleotide in the sample; and (d) predicting the presence or assessing status of IBD when the level of at least one RORγt⁺Th cell specific nucleotide in the patient is higher than a predetermined level of the RORγt⁺Th cell specific nucleotide.

One embodiment provides a method for diagnosing IBD in a patient by: (a) obtaining a sample from a patient exhibiting symptoms associated with IBD; (b) detecting the presence of a RORγt⁺Treg cell specific nucleotide in the sample; and (c) predicting the presence or assessing status of IBD when the level of at least one RORγt⁺Treg cell specific nucleotide in the patient is higher than a predetermined level of the RORγt⁺Treg cell specific nucleotide.

One embodiment provides a method of screening for a therapeutic composition useful for treating IBD or people at risk of IBD by: (a) identifying an individual that exhibits symptoms associated with IBD in that type of individual; (b) treating the individual with a therapeutic composition; and (d) determining whether the therapeutic composition reduces the amount of RORγt⁺Th cells present in the GI of the individual below a predetermined level.

One embodiment provides a method of screening for a therapeutic composition useful for treating IBD or people at risk of IBD by: (a) identifying an individual that exhibits symptoms associated with IBD in that type of individual; (b) treating the individual with a therapeutic composition; and (d) determining whether the therapeutic composition increases the amount of RORγt⁺Treg cells present in the GI of the individual above a predetermined level.

One embodiment provides a method of screening for a therapeutic composition useful for treating IBD or people at risk of IBD by: (a) identifying an individual that is an animal model of IBD and that exhibits symptoms associated with IBD in that individual; (b) treating the individual with a therapeutic composition; and (d) determining whether the therapeutic composition reduces the amount of RORγt⁺Th cells present in the GI of the individual below a predetermined level.

One embodiment provides a method of screening for a therapeutic composition useful for treating IBD or people at risk of IBD by: (a) identifying an individual that is an animal model of IBD and that exhibits symptoms associated with IBD in that individual; (b) treating the individual with a therapeutic composition; and (d) determining whether the therapeutic composition increases the amount of RORγt⁺Treg cells present in the GI of the individual above a predetermined level.

One embodiment provides a method of screening for a therapeutic composition useful for treating IBD or people at risk of IBD by: (a) infecting an individual that is an animal model of the human GI with bacterial cultures from individuals with IBD; (b) waiting until the individual exhibits symptoms associated with IBD; (c) treating the individual with a therapeutic composition; and (d) comparing the amount of RORγt⁺Th cells present in the GI of the infected individual to the amount of RORγt⁺Th cells in a healthy individual.

One embodiment provides a method of screening for a therapeutic composition useful for treating IBD or people at risk of IBD by: (a) infecting an individual that is an animal model of the human GI with bacterial cultures from individuals with IBD; (b) waiting until the individual exhibits symptoms associated with IBD; (c) treating the individual with a therapeutic composition; and (d) comparing the amount of RORγt⁺Treg cells present in the GI of the infected individual to the amount of RORγt⁺Treg cells in a healthy individual.

One embodiment provides a method of screening for a therapeutic composition useful for treating IBD or people at risk of IBD by: (a) identifying an animal that serves as a model of IBD and that has IBD; administering a therapeutic composition to that individual; and (b) assaying the effect of the therapeutic composition on the RORγt⁺Th cell levels in the GI of the animal.

One embodiment provides a method of screening for a therapeutic composition useful for treating IBD or people at risk of IBD by: (a) identifying an animal that serves as a model of IBD and that has IBD; administering a therapeutic composition to that individual; and (b) assaying the effect of the therapeutic composition on the RORγt$^+$Treg cell levels in the GI of the animal.

One embodiment provides a method of screening for a therapeutic composition useful for treating IBD or people at risk of IBD by: (a) administering a therapeutic composition to a patient diagnosed with IBD and (b) assaying the effect of the therapeutic composition on the levels of RORγt$^+$Th cells in the gut of the patient; (c) comparing the levels of bacterial communities in the treated patient with levels of RORγt$^+$Th cells in a healthy individual; and (d) determining whether the therapeutic composition caused levels of RORγt$^+$Th cells to reach a predetermined level in the patient.

One embodiment provides a method of screening for a therapeutic composition useful for treating IBD or people at risk of IBD by: (a) administering a therapeutic composition to a patient diagnosed with IBD and (b) assaying the effect of the therapeutic composition on the levels of RORγt$^+$Treg cells in the gut of the patient; (c) comparing the levels of strain 1687A6 in the treated patient with levels of RORγt$^+$ Treg cells in a healthy individual; and (d) determining whether the therapeutic composition caused levels of RORγt$^+$Treg cells to reach a predetermined level in the patient.

FIG. 1 shows that IBD-associated microbiotas enhance induction of gut RORγt+Th compared to healthy donor microbiotas in gnotobiotic mice. (A and B) The proportion of gut RORγt+Th varies in individual mice colonized with different donor microbiotas. Shown is the proportion of RORγt+ cells of CD4+FoxP3-. Flow cytometry plots include data acquired at different times, thus gating differs between plots. (C) The mean proportion of RORγt+Th induced in the colon, ileum, and mLN of groups of mice colonized with IBD donor microbiotas is greater than with healthy micro-biotas. (D) The correlation between the proportion of RORγt+Th induced in colon, ileum, and mLN by each microbiota. (E) The proportion of RORγt+Th and IL-17A+ CD4 T cell induced by a microbiota are correlated. (F, G and H) The mean proportion of (F) IL-17A+Th17 cells, (G) IFNγ+Th1 cells, (H) IL-22$^-$T cells induced in colon and ileum is equivalent with healthy or IBD donor microbiotas. Cells are gated as in FIG. 1A. (I) The proportion of gut GATA3+Th in individual mice colonized with different donor microbiotas. Shown is the proportion GATA3+ cells of CD4$^+$FoxP3$^-$. (J) The mean proportion of GATA3+Th induced in the colon ileum of groups of mice colonized with healthy and IBD microbiotas. (A-J) n=15 healthy, 8 UC and 7 CD microbiotas (RORγt), n=11 healthy, 6 UC and 7 CD microbiotas (IFNγ and IL-17A), n=8 healthy, 4 UC and 6 CD microbiotas (IL-22), n=10 healthy, 5 UC and 2 CD microbiotas (GATA3); (B and I) each point represents data from one mouse, in all other plots each point represents the mean value of a group of 2-12 mice colonized with a single microbiota. ns—not significant, *p<0.05, Students t-test; solid horizontal lines indicate mean±SEM, dashed horizontal lines represent the mean proportion of the cell type in germ free mice. Regression p values in (E) calculated by f-test.

FIG. 2 shows that induction of gut FoxP3+ Treg is not significantly different between mice colonized with healthy and IBD microbiotas. (A and B) The proportion of FoxP3+ Treg varies between individual mice colonized with different donor microbiotas. Shown is the proportion of FoxP3+ cells as a percentage of CD4+ T cells. Flow cytometry plots include data from different experiments, thus gating differs between plots. (C and D) The mean proportion of FoxP3+

Treg (C) and IL-10+CD4 T cells (D) induced in colon and ileum are not significantly different between healthy and IBD donor microbiotas. Shown is the proportion of FoxP3+ or IL-10+ cells as a percentage of CD4+ T cells. (E) IL-10 secretion is predominantly restricted to FoxP3+ lamina propria T cells. Shown are flow cytometry plots, gated on CD4+ T cells, representative of mice colonized with three healthy and three IBD microbiotas. (F) The proportion of gut RORγt+ Th and FoxP3+ Treg induced by different micro-biotas are not correlated. (A-E) n=11 healthy, 6 UC and 7 CD microbiotas; (B) each point represents data from one mouse, in all other plots each point represents the mean value of a group of 3-12 mice colonized with a single microbiota. ns—not significant, Students t-test; solid hori-zontal lines indicate mean±SEM, dashed horizontal lines represent the mean proportion of the cell type in germ free mice. Regression p values in (F) calculated by f test.

FIG. 3 shows that healthy donor microbiotas specifically enhance induction of gut RORγt+Treg compared to IBD-associated microbiotas. (A and B) The proportion of gut RORγt+Treg varies in individual mice colonized with dif-ferent donor microbiotas. Shown is the proportion of RORγt+ ells as a percentage of CD4+ FoxP3+ T cells. Flow cytometry plots include data from different experiments, thus gating differs between plots. (C and D) The mean proportion of RORγt+ Treg induced in the colon or ileum of groups of mice colonized with healthy donor microbiotas is greater than with IBD microbiotas (C). (D) shows data from (C), segregated according to cohort. (E) The mean propor-tion of RORγt+Treg induced in the mLN is not significantly different between groups of mice colonized with healthy or IBD donor microbiotas. (F) The proportion of RORγt+Treg induced by each microbiota is correlated between colon and ileum, but not between mLN and either gut tissue. (G) The majority of colon lamina propria T cell-derived IL-17A secretion is from FoxP3-cells. Shown are flow cytometry plots representative of at least three mice per microbiota. Gated on CD4+ RORγt+ cells; flow cytometry plots include data from different experiments, thus gating differs between plots. (A-F) n=15 healthy, 8 UC and 7 CD microbiotas; (B) each point represents data from one mouse, in all other plots each point represents the mean value of a group of 2-12 mice colonized with a single microbiota. ns—not significant, *p<0.05, p<0.01, * p<0.001, Students t-test; solid hori-zontal lines indicate mean±±SEM, dashed horizontal lines represent the mean proportion of the cell type in germ free mice. Regression p values calculated by f-test.

Figures 11A, 11B:
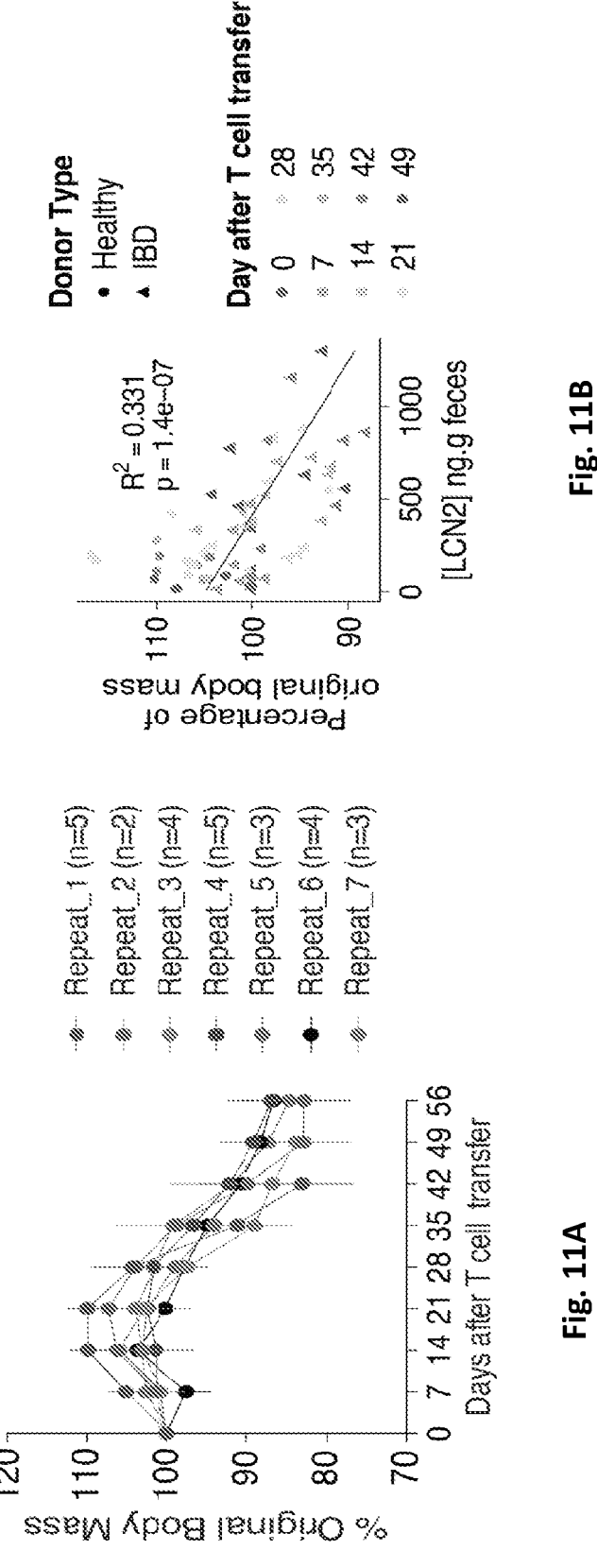
FIG. 11A-G. The figures show that IBD-associated microbiotas transmit enhanced 819 colitis severity to susceptible mice.

FIG. 4 shows that IBD-associated microbiotas transmit enhanced colitis severity to susceptible mice. Rag−/−T cell transfer (RagTCT) colitis in mice colonized with healthy or IBD donor microbiotas. (A and B) Body mass loss (A) and fecal lipocalin2 (LCN2) (B) were significantly greater in RagTCT mice colonized with IBD donor microbiotas rela-tive to healthy microbiotas. (C) Representative H&E stained colon sections from RagTCT mice colonized with different human donor microbiotas 5-7 weeks after T cell transfer. (D) Body mass loss was greater at week 6 in RagTCT mice colonized with human UC or CD microbiotas. (E and F) Exacerbated colitis severity is transferred by IBD donors from two cohorts (E) and with both stool and cultured IBD microbiotas (F). (G) The proportion of RORγt+Th and IFNγ+IL-17A+ of CD4+ T cells induced in the colon of RagTCT mice colonized with IBD donor microbiotas is greater than with healthy microbiotas 4 weeks after TCT. Each point represents data from one mouse, each color represents a different microbiota. (H) Representative flow cytometry plots demonstrating induction of RORγt+ Treg from the progeny of transferred naïve T cells in the colon lamina propria 4 weeks after TCT. Gated on CD4+ cells. (I) The proportion of FoxP3+Treg and RORγt+ Treg induced in the colon of RagTCT mice is not significantly different between IBD and healthy microbiotas 4 weeks after TCT. Each point represents data from one mouse; each color represents a different microbiota. Proportions of FoxP3+ Treg are as a percentage of CD4+ T cells and RORγt+ Treg are as a percentage of CD4+FoxP3+ (A, B) Thin lines represents the mean data from a group of 5-15 mice colonized with a single microbiota and bold lines represent the mean±SEM of all groups of mice colonized with either healthy donor or IBD donor microbiotas. (C) Scale bar=200 μm. (DG) Each point shows the mean weight change of a group of 5-15 mice 6 weeks after T cell transfer (n=16 healthy donors, n=6 CD donors, n=6 UC donors (of which 2 UC and 2 CD had active disease). P values are calculated using ANOVA with Tukey's correction for multiple comparisons (D) or Students t-test (all other panels). ns—not significant, p<0.01, *p<0.001, ****p<0.0001; Students t-test). See also: FIGS. 11 and 12 (G and I) Each point represents data from one mouse, each color represents a different microbiota.

FIG. 5 shows that homeostatic induction of RORγt+Treg and RORγt+Th predicts experimental colitis severity and human microbiota donor health. (A) RagTCT colitis severity is significantly correlated with RORγt+Th and RORγt+Treg, homeostatically induced in the colon and ileum of B6 gnotobiotic mice colonized with the same microbiota. Colitis severity is not correlated with the proportion of GATA3+ Th or FoxP3+Treg in B6 gnotobiotic mice. (B) Receiver Operating Characteristic (ROC) curves assessing the value of logistic models based on measurements made in humanized microbiota mice as binary classifiers to predict the health of the microbiota donor. (A and B) The body weight data represents the mean measurements of groups of 5-15 RagTCT mice colonized with a single human donor microbiota and the phenotyping data is the mean value of a group of 2-12 B6 mice colonized with the same single microbiota. P values are calculated by f-test.

Figure 6:
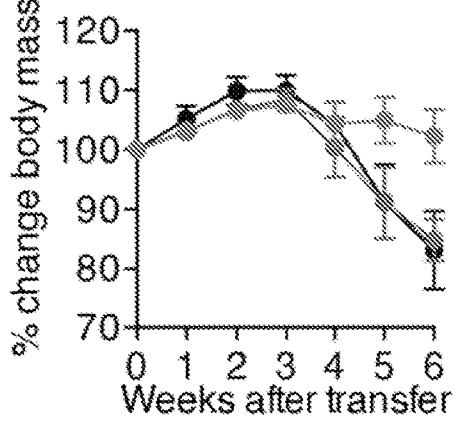
FIG. 6. The figure shows that RORγt+Treg cells are required to reduce disease severity in colitis susceptible T-cell transfer mice colonized with a healthy donor microbiota.

FIG. 6 shows that RORγt⁺Treg cells are required to reduce disease severity in colitis susceptible T-cell transfer mice colonized with a healthy donor microbiota. Specifically, a high RORγt⁺Treg inducing healthy donor microbiota (HD2021) results in less disease severity (weight loss) than that of gnotobiotic colitis susceptible mice colonized with a low RORγt⁺Treg inducing microbiota from an individual with ulcerative colitis (UC1024). This reduction in disease severity is eliminated if the T-cell transfer mice receive naïve T-cells which cannot differentiate into RORγt⁺Treg (RORγt fox×FoxP3-cre donor cells). There is no difference between the disease severity between the healthy microbiota receiving RORγt⁺Treg-deficient cells and the ulcerative colitis microbiota colonized mice receiving wildtype cells.

Figures 7A, 7B, 7C:
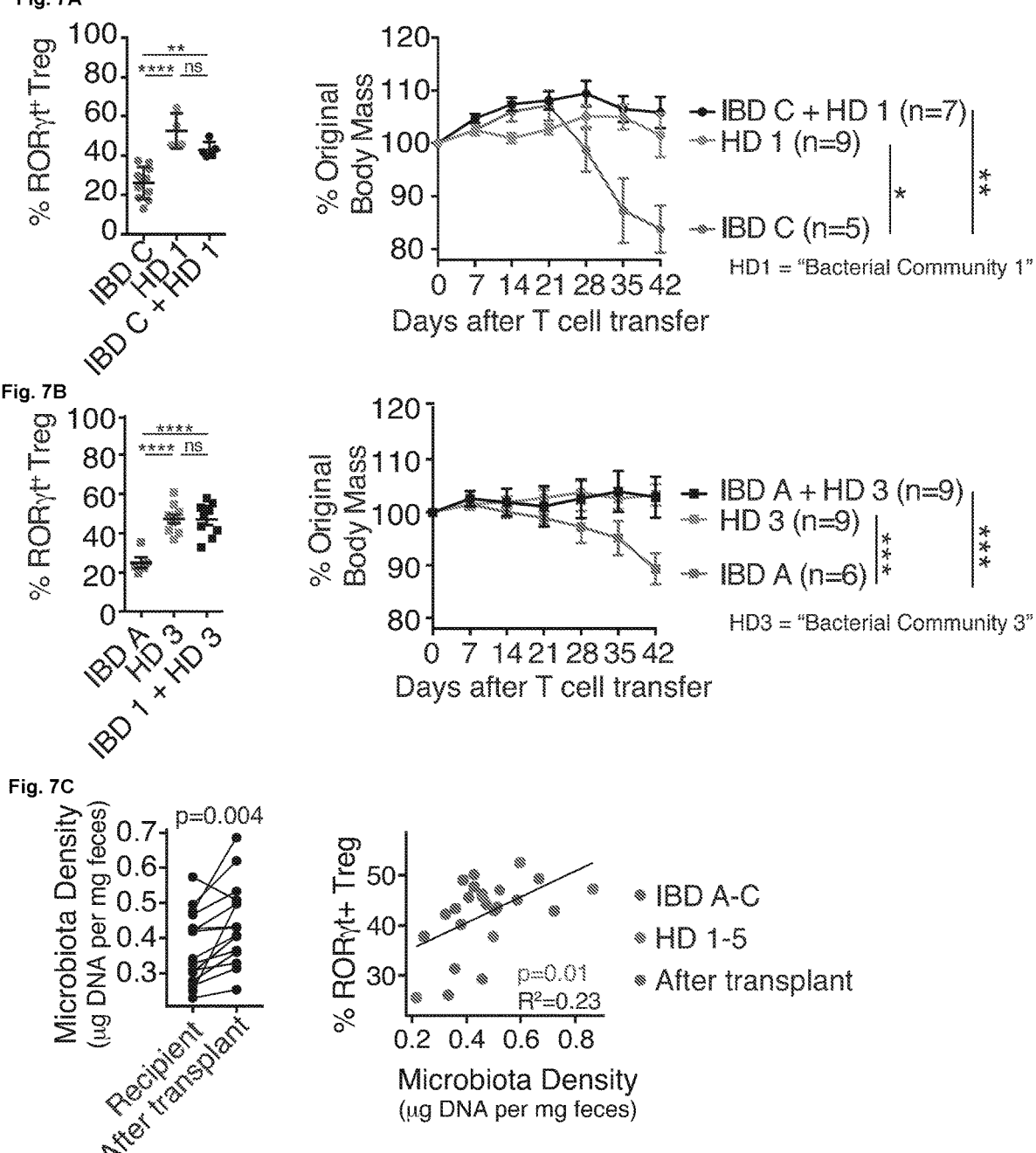
FIG. 7A-C. The figure shows that a (cultured) donor microbiota can induce colon RORγt+Treg when given as a therapeutic cocktail to a gnotobiotic mouse harboring a low RORγt+Treg inducing microbiota from an individual with IBD (data in left pane are in healthy unchallenged mice).

FIGS. 7 (A and B) shows that two (cultured) donor microbiotas can induce colon RORγt+Treg when given as a therapeutic cocktail to gnotobiotic mice harboring low RORγt+Treg inducing microbiotas from individuals with IBD (data in left panes are in healthy unchallenged mice). If the same RORγt+Treg inducing cocktails are transplanted into colitis-susceptible T-cell transfer mice harboring the low RORγt+Treg inducing IBD microbiotas, the disease pathogenesis (weight loss) is reduced in both cases. (C) shows that microbiota density increases following transplant of RORγt+Treg inducing cocktails into gnotobiotic mice harboring microbiotas from donors with IBD, and this increase in microbiota density correlates with the increase in RORγt+Treg cells in the colon.

Figure 8:
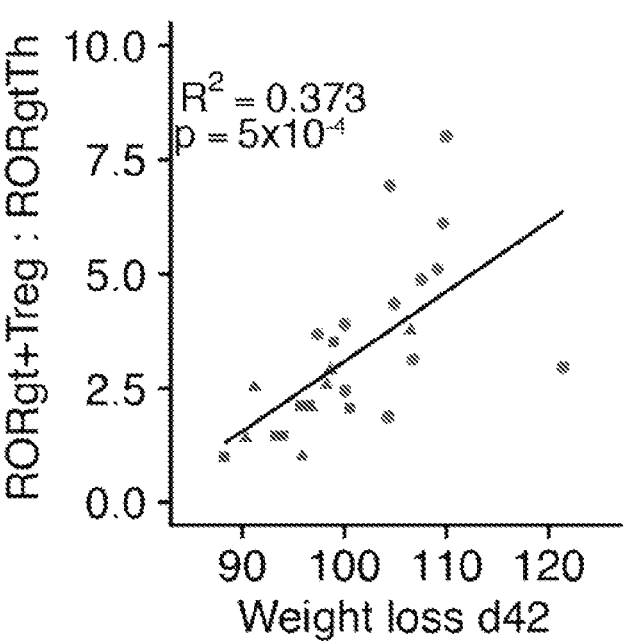
FIG. 8. The figure shows that the human microbiota-induced ratio of RORγt+Treg and RORγt+Th (Th17 cells) in unchallenged gnotobiotic mice can predict disease severity in colitis susceptible T-cell transfer mice and can predict the disease status of the human donor.

FIG. 8 shows that the human microbiota-induced ratio of RORγt⁺Treg and RORγt⁺Th (Th17 cells) in unchallenged gnotobiotic mice can predict disease severity in colitis susceptible T-cell transfer mice and can predict the disease status of the human donor. See also FIG. 5B providing the AUC.

Figures 1C, 1D, 1E, 1F:
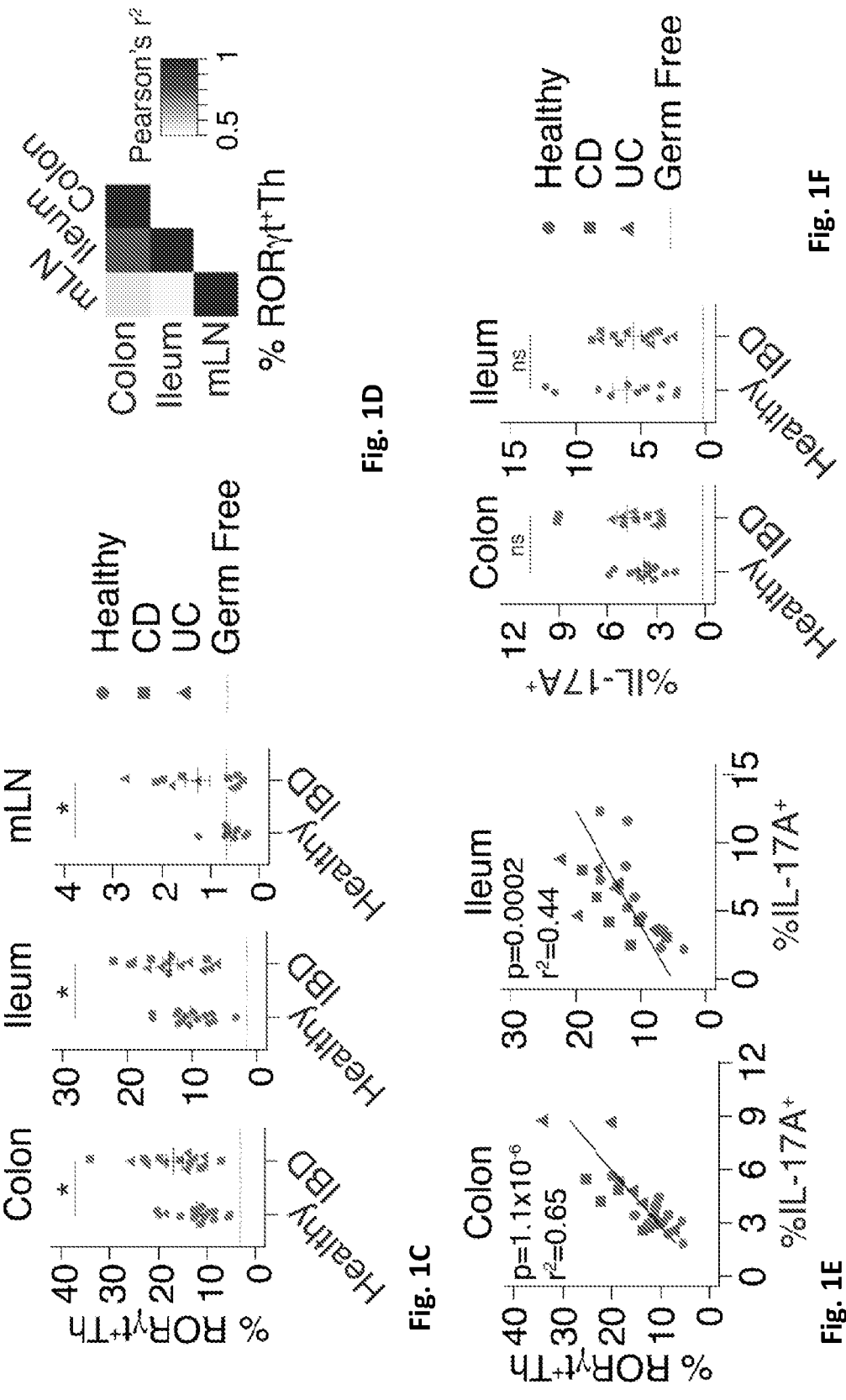
Figures 9A, 9B:
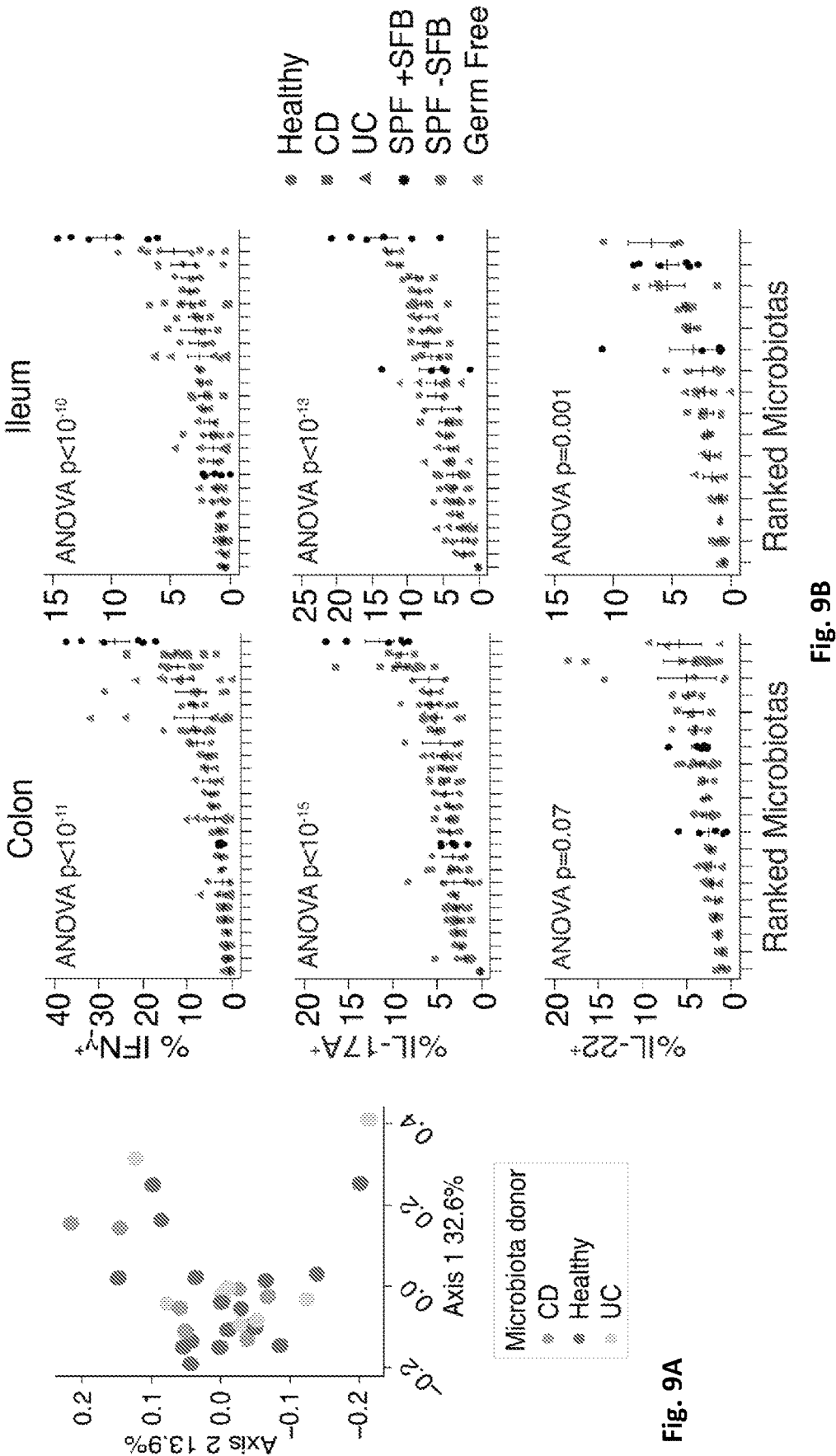
FIG. 9A-D. The figures show that the proportions of gut Thelper populations are influenced by microbiota donor.
Figures 9C, 9D:
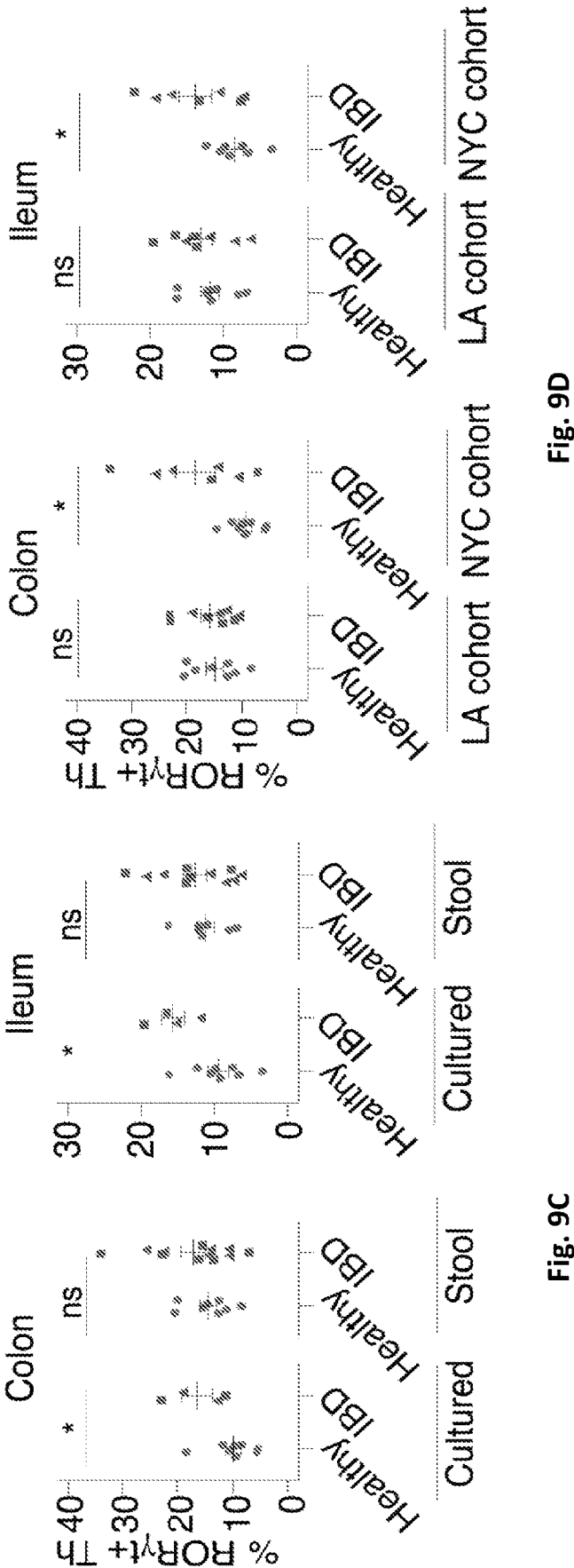

FIG. 9 shows that the proportions of gut Thelper populations are influenced by microbiota donor. (A) PCoA based on unweighted UniFrac distances of 16S rDNA amplicon sequencing of the human donor microbiotas used in this study reveal no significant disease-associated clustering. Related to Table 1. (B) The proportions of colon and ileum IFNγ+, IL-17A+ and IL-22+ CD4+ T cells are significantly influenced by the donor microbiota. Each symbol represents data from one mouse. (C) The proportion of RORγt+ Th induced by donor microbiotas in colon and ileum of B6 gnotobiotic mice colonized with either cultured collections of microbes or total stool microbiota. Each point represents the mean value of a group of 2-12 mice colonized with a single microbiota. Data is also shown in FIG. 1C, but here is segregated according to the type of microbiota inoculum. (D) The proportion of RORγt+ Th induced by donor microbiotas in colon and ileum of B6 gnotobiotic mice colonized with microbiotas from two independent cohorts of donors. Each point represents the mean value of a group of 2-12 mice colonized with a single microbiota. Data is also shown in FIG. 1C, but here is segregated according to donor cohort. (B) n=11 healthy, 6 UC and 7 CD microbiotas (IFNγ and IL-17A), n=8 healthy, 4 UC and 6 CD microbiotas (IL-22); each point represents data from one mouse. (C and D) each point represents the mean value of a group of 2-12 mice colonized with a single microbiota. ns—not significant, *p<0.05, Students t-test; horizontal lines indicate mean±SEM. See also FIG. 1.

FIG. 10 shows that healthy donor microbiotas specifically enhance induction of gut RORγt+Treg compared to IBD-associated microbiotas. (A) The proportion of RORγt+ Treg induced by donor microbiotas in colon and ileum of B6 gnotobiotic mice colonized with either cultured collections of microbes or total stool microbiota. Each point represents the mean value of a group of 2-12 mice colonized with a single microbiota. Data is also shown in FIG. 3C, but here is segregated according to the type of microbiota inoculum. (B) The mean proportion of Helios+ Treg in colon and ileum is equivalent with healthy or IBD donor microbiotas. Shown is the mean proportion of Helios+ cells as a percentage of CD4+FoxP3+ cells. (C) The mean proportion of GATA3+ Treg in colon and ileum is equivalent with healthy or IBD donor microbiotas. Shown is the mean proportion of Helios+ cells as a percentage of CD4+FoxP3+ cells. (D) Correlations between the proportions of colon and ileum FoxP3+Treg, GATA3+ Treg, Helios+Treg and RORγt+ Treg induced by different human microbiotas. (E) Induction of colon IL-22+, Csf2+ and IL-17A+ ILC3 by four different human microbiotas. Shown is the proportion of cytokine positive cells as a percentage of CD45+, CD3/CD19-, NKp46-, RORγt+ cells. Each point represents data from one mouse and each group shows data from a different microbiota. Statistical comparisons are made using data from all mice colonized with healthy or IBD microbiotas. (F) Correlations between the proportions of colon and ileum RORγt+Treg with RORγt+ Th, GATA3+Th and IFNγ+ Th induced by different human microbiotas. Each point represents the mean data from a group of 2-12 mice. (G) Expression of CD80 and CD86 on DC and macrophages/monocytes from mice colonized with representative healthy (high RORγt+Treg, low RORγt+ Th) and IBD (low RORγt+Treg, high RORγt+Th) microbiotas. DC were gated MHCII+, CD64−, CD11c+. Macrophages/monocytes (Mac/mono) were gated MHCII+, CD64+. (A-C and F) n=15 healthy, 8 UC and 7 CD microbiotas; each point represents the mean value of a group of 2-12 mice colonized with a single microbiota. (E and G) Each point represents data from a single mouse. ns—not significant, *p<0.05,  p<0.01, *p<0.0001, Students t-test (A-C, E, G) or f-test (F); solid horizontal lines indicate mean±SEM, dashed horizontal lines indicate the mean proportion of cells from a group of germ free mice. See also FIGS. 2 and 3.

FIG. 11 shows that IBD-associated microbiotas transmit enhanced 819 colitis severity to susceptible mice. (A) A group of mice colonized with donor microbiota UC1024 was included in all T cell transfer colitis experiments to assess the efficacy and consistency of colitis induction. Shown are weight loss curves for 7 groups of mice, which served as the control group for TCT experiments performed at intervals over approximately 24 months. (B) Following induction of T cell transfer colitis, loss in body mass is significantly correlated with an elevation of fecal lipocalin2. (C) Exacerbated colitis in mice colonized with IBD microbiotas can be detected early after T cell transfer. (D) IBD-associated microbiotas from two donor cohorts transmit more severe colitis to mice than healthy donor microbiotas. (E) Complete fecal microbiotas and cultured collections of bacteria from IBD donors both transmit more severe colitis to mice than equivalent microbiotas derived from healthy donors. (F) Colitis severity is equivalent in RagTCT mice colonized with IBD microbiotas from donors who have active disease or are in remission. (G) Comparison of ten donor microbiotas that were assessed for colitogenicity in mice as both stool and cultured collection. (A) Lines represent the mean±SEM of groups of mice colonized with donor UC1024. (B) Each point shows data from one mouse at one timepoint from the time of T cell transfer. (C) Each point represents the mean weight loss of a group of 5-15 mice colonized with a microbiota at the indicated time after T cell transfer. Lines represent the mean±SEM of all healthy or IBD microbiotas. (D and E) Each thin line represents the mean data from a group of 5-15 mice colonized with a single microbiota. Bold lines represent the mean±SEM of all groups of mice colonized with either a healthy donor or IBD donor microbiotas. (F) Each point represents the mean weight loss of a group of 5-15 mice colonized with a microbiota 6 weeks after T cell transfer. (G) The mean weight change of groups of 5-15 mice colonized with either the complete stool microbiota or the cultured collection.

FIG. 12 shows that the gut microbiota relative abundances are stable following colitis induction. (A) We find no significant associations of alpha diversity (defined by Shannon index) and health status of the microbiota donor. Alpha diversity is also not significantly altered six weeks after T-cell transfer. (B) There were no significant changes in the relative abundance of the five major phyla detected in feces from Rag-deficient mice colonized with healthy or IBD microbiotas before and 6 weeks after T cell transfer. Lines connect the mean proportions from the same group of mice colonized with the same microbiota. Boxplots show the median and interquartile range. Statistical comparisons by paired Student's t-test. See also FIG. 4.

FIG. 13 shows a relationship between homeostatically-induced T cell populations and colitis severity. (A-D) Homeostatically-induced (A) IL-17A+ CD4+ T cells in the colon but not the ileum of B6 gnotobiotic mice are correlated with colitis severity (as measured by weight loss) of Rag-TCT mice colonized with the same microbiotas. In contrast, the proportions of homeostatically induced (B), IFNγ+Th, (C), Helios+Treg or (D), IL-10+ CD4 T cells in the colon and ileum of B6 gnotobiotic mice are uncorrelated with colitis severity (as measured by weight loss) of RagTCT mice colonized with the same microbiotas. (A-D) Each symbol represents the mean value from a group of 3-12 mice colonized with a single microbiota. p values calculated by f-test. See also FIG. 5.

The effect of reducing or inhibiting differentiation, proliferation, or accumulation of RORγt+Th cells can be evaluated, for example, by: administering a therapeutic composition to a subject with IBD, isolating CD4-positive cells from the GI, measuring by flow cytometry the ratio of RORγt+Th cells contained in the CD4-positive cells, and comparing the post-administration RORγt+Th cell ratio to the pre-administration ratio or a predetermined level of RORγt+Th cells.

The effect of stimulating or enhancing the differentiation, accumulation, or proliferation of RORγt+Treg cells can be evaluated, for example, by: administering a therapeutic composition to a subject with IBD, isolating CD4-positive cells from the GI, measuring by flow cytometry the ratio of RORγt+Treg cells contained in the CD4-positive cells, and comparing the post-administration RORγt+Treg cell ratio to the pre-administration ratio or a predetermined level of RORγt+Treg cells.

One can determine whether the "reducing or eliminating differentiation, accumulation, or proliferation of RORγt+Th cells" is occurring, for example, by assaying the ratio of RORγt+Th cells in the T cell group of the GI, a function of RORγt+Th cells in the GI, or expression of a marker of RORγt+Th cells in the GI.

One can determine whether the "stimulating or enhancing the differentiation, accumulation, or proliferation of RORγt+ Treg cells" is occurring, for example, by assaying the ratio of RORγt+Treg cells in the T cell group of the GI, a function of RORγt+Treg cells in the GI, or expression of a marker of RORγt+Treg cells in the GI.

Methods of detecting RORγt+Th cell or RORγt+Treg cell RNA expression markers include, for example, high throughput RNA screening, northern blotting, dot blotting, and RT-PCR. Examples of methods for detecting protein markers include, for example, ELISA, radioimmunoassay, immunoblotting, immunoprecipitation, and flow cytometry.

The present disclosure can provide methods for determining the effects of a therapeutic composition by measuring the absolute amount or the ratio of RORγt+Th cells or RORγt+ Treg cells in a microbiota of an individual diagnosed with IBD, treating the individual with a therapeutic composition, and evaluating whether the absolute amount or ratio of RORγt+Th cells is reduced or of RORγt+Treg cells is increased in comparison with a base line value obtained by performing a similar evaluation on a healthy individual.

One embodiment of the present disclosure provides a method for predicting a patient's response to a therapeutic composition and provide a prognosis. The method comprises measuring the percentage or absolute amounts measuring the absolute amount or the ratio of RORγt+Th cells or RORγt+Treg cells in a microbiota of an individual diagnosed with IBD. Comparing the values to baseline values for those amounts in a healthy subject. Combining the results of the comparison with additional diagnostic information and medical history data related to the patient. Evaluating whether the patient may show a reduction in IBD after administration of a particular therapeutic composition.

EXAMPLES

Provided below are select examples of certain embodiments; however, the disclosure is not limited to these examples or the specific embodiments recited above.

The present disclosure provides methods and markers that can be used to predict the severity of IBD in humans. In particular, the present disclosure shows that individuals harboring communities that enrich tolerogenic RORγt+Treg cells are at lower risk, while those harboring communities that enrich RORγt+Treg cells are at increased risk. The inventors have further discovered a close association between microbiota-specific homeostatic RORγt+Treg cell induction and colitis severity. Furthermore, this disclosure provides microbiota compositions as a therapeutic intervention in IBD.

IBD-Associated Microbiotas Enhance Induction of Gut RORγt+ Th17 Compared to Healthy Donor Microbiotas in Gnotobiotic Mice The inventors have identified specific markers that are correlated with IBD in human gut microbiotas. To identify these markers, the inventors colonized germ free C57B1/6J mice with fecal slurries or arrayed cultured fecal microbiota collections from two independent cohorts of either related or unrelated healthy donors (n=15) or donors with IBD (n=15). See Table 1 below.

TABLE 1

Gut microbiota samples included in gnotobiotic experiments.

| Microbiota name | Donor diagnosis | Cohort | B6 immune phenotyping | TCT colitis susceptible |
|---|---|---|---|---|
| CD1001 | CD | familial | C, S | C, S |
| CD1002 | CD | familial | C | C, S |
| CD1003 | CD | familial | S | C, S |
| CD1004 | Healthy | familial | S | S |
| HD1007 | Healthy | familial | C | C |
| HD1008 | Healthy | familial | — | S |
| HD1009 | Healthy | familial | — | S |
| HD1010 | Healthy | familial | S | S |
| HD1011 | UC | familial | — | C, S |
| HD1012 | Healthy | familial | — | S |
| HD1013 | CD | familial | S | S |
| HD1014 | Healthy | familial | S | S |
| HD1015 | Healthy | familial | — | S |
| HD1016 | Healthy | familial | S | — |
| UC1024 | UC | familial | C | C, S |
| UC1025 | UC | familial | C | — |
| UC1026 | UC | familial | S | C, S |
| UC1027 | Healthy | familial | — | S |
| CD2005 | CD | non-familial | S | S |
| CD2006 | CD | non-familial | S | C, S |
| HD2017 | Healthy | non-familial | C | C |
| HD2018 | Healthy | non-familial | C, S | C |
| HD2019 | Healthy | non-familial | C | C, S |
| HD2020 | Healthy | non-familial | C | C |
| HD2021 | Healthy | non-familial | C | C, S |
| HD2022 | Healthy | non-familial | — | C |
| HD2023 | Healthy | non-familial | C | C |
| UC2028 | UC | non-familial | S | S |
| UC2029 | UC | non-familial | S | S |
| UC2030 | UC | non-familial | S | C, S |
| UC2031 | UC | non-familial | S | S |
| UC2032 | UC | non-familial | — | S |

C = gnotobiotic mice colonized with arrayed culture collection derived from donor fecal microbiota
S = gnotobiotic mice colonized with clarified fecal microbiota from donor Microbiota analysis by 16S rDNA amplicon sequencing did not distinguish between the fecal microbiotas of healthy donors and donors with CD or UC (p=0.58, PERMANOVA; FIG. 9A. Principle coordinates analysis weakly segregated the fecal microbiota of humanized microbiota mice colonized with healthy, CD or UC donor microbiotas (p=0.04, PERMANOVA, FIG. 9B).

After 4-6 weeks of colonization, the inventors profiled the intestinal lamina propria of each mouse by flow cytometry. The proportion of lamina propria RORγt+ of CD4+FoxP3− T helper cells (RORγt+Th) in colon and ileum varied significantly between donor microbiotas ($p<1\times10^{-12}$, ANOVA; FIG. 1A). Strikingly, the average proportion of RORγt+Th induced by IBD microbiotas was significantly higher than healthy donor-derived microbiotas in both colon and ileum (p=0.009 p=0.034 respectively; t-test; FIGS. 1A-C and 9). This discovery was most evident when comparing cultured microbiotas and in the cohort of unrelated donors (FIG. 10). RORγt+Th cells varied over a 6-fold range and included human microbiotas inducing similar proportions to commonly used mouse reference communities (specific pathogen free (SPF) microbiotas+/−segmented filamentous bacteria (SFB)). In addition, RORγt+ Th cells were also elevated in the mesenteric lymph node (mLN) of mice colonized with IBD microbiotas (FIG. 1C). Induction of RORγt+Th cells was highly correlated between colon and ileum, and more moderately correlated between both tissues and mLN (FIG. 1D).

The inventors found that the proportion of RORγt+Th cells was correlated with the proportion of IL-17A+ CD4 T-cells within each tissue (colon; $p=1.1\times10^{-6}$, $R^2=0.65$, ileum; $p=0.0002$, $R^2=0.44$; FIG. 1E). Although the proportion of IFNγ+ Th1, IL-22+ and IL-17A+ CD4 T cells varied by donor microbiota ($p<1\times10^{-10}$ [IFNγ and IL-17A], p=0.001 [IL-22, ileum], ANOVA) (Figure S1), the inventors discovered that these T cell subsets were not significantly altered by healthy microbiotas compared with IBD microbiotas (FIGS. 1F, 1G and 1H). In contrast, they found that the average proportion of FoxP3−GATA3+Th2 cells was higher in the colon of mice colonized with IBD microbiotas ((p<0.05, t-test); FIG. 1J).

Figure 2A:
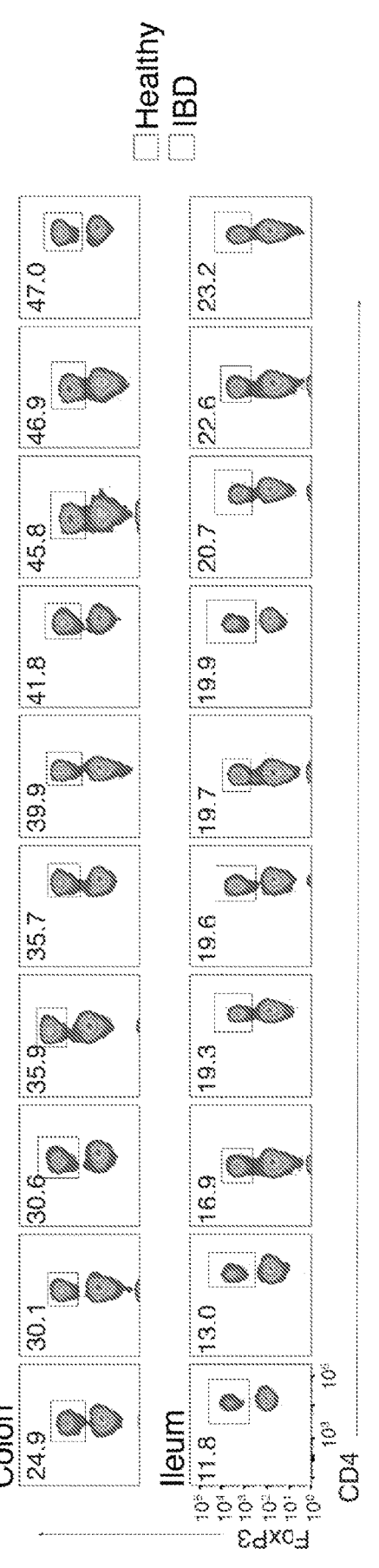
FIG. 2A-F. The figures show that induction of gut FoxP3+ Treg is not significantly different between mice colonized with healthy and IBD microbiotas.
Figures 2B, 2C, 2D, 2E:
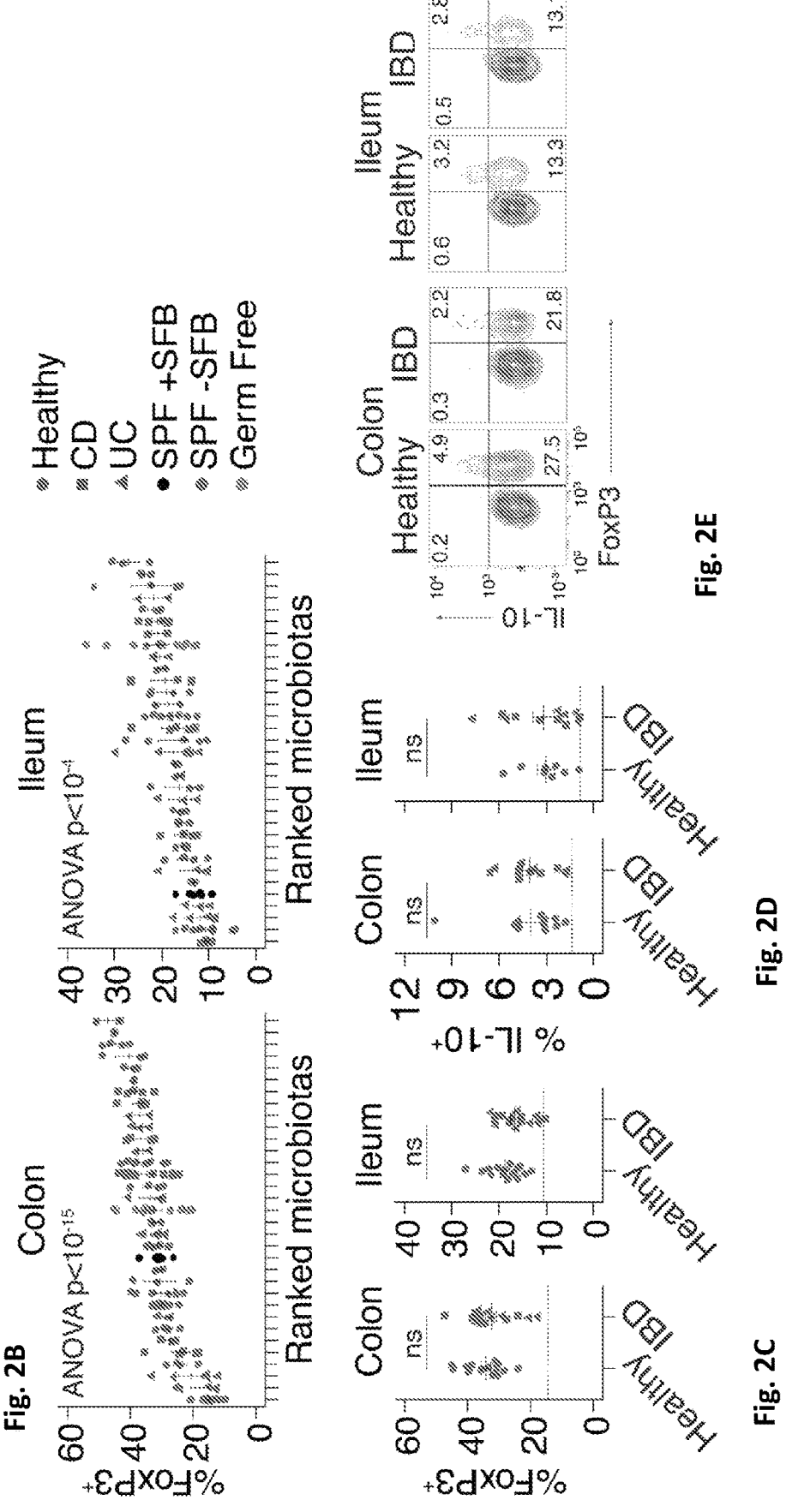
Figure 2F:
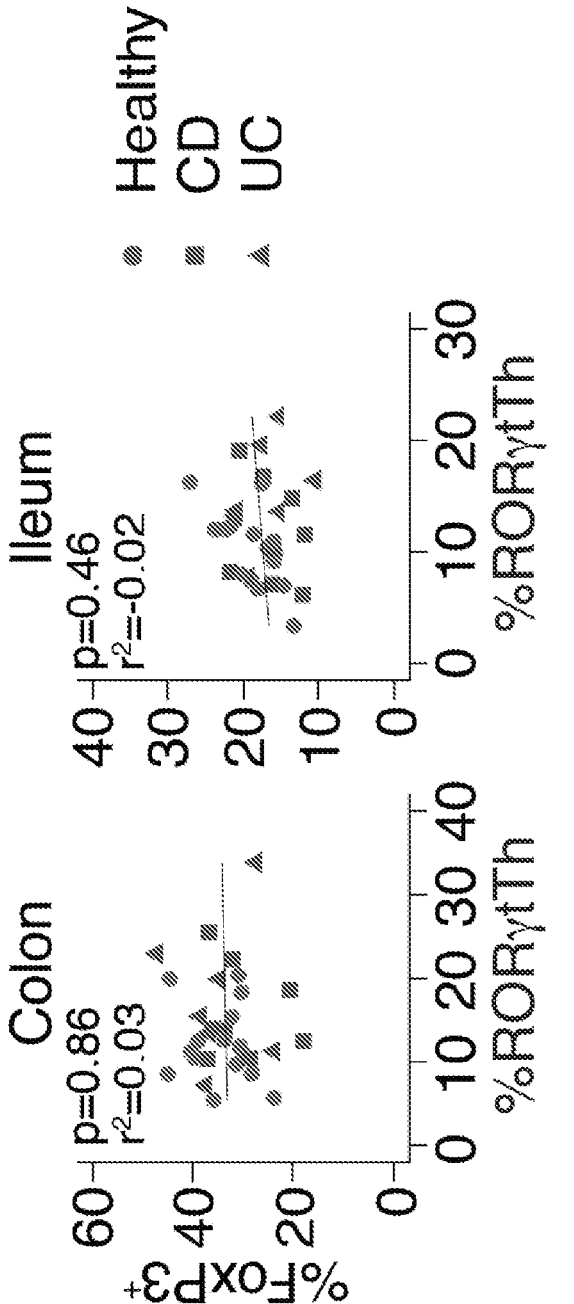

Induction of Gut FoxP3+ 102 Treg is not Significantly Different Between Mice Colonized with Healthy and IBD Microbiotas As in previous studies (Faith et al. 2014, Geva-Zatorsky et al. 2017), the majority of microbiotas led to an expansion of gut FoxP3+Treg above baseline germ-free levels (FIGS. 2A and 2B). The inventors discovered that although the proportions of FoxP3+Treg and IL-10+ CD4 T cells were significantly influenced by donor microbiota ($p<1\times10^{-15}$, p<0.0001 [FoxP3 colon, ileum], p=0.006, p=0.02 [IL-10 colon, ileum]; ANOVA), there was no observable difference between the mean proportion of FoxP3+Treg or IL-10+ CD4 T cells induced by healthy or IBD-associated microbiotas (FIGS. 2C and 2D). The majority of CD4+ T cell-derived IL-10 detected by intracellular cytokine straining was within FoxP3+ T cells (FIG. 2E). In addition, the proportion of RORγt+Th and FoxP3+ Treg induced by a microbiota were not correlated (FIG. 2F).

Figure 3A:
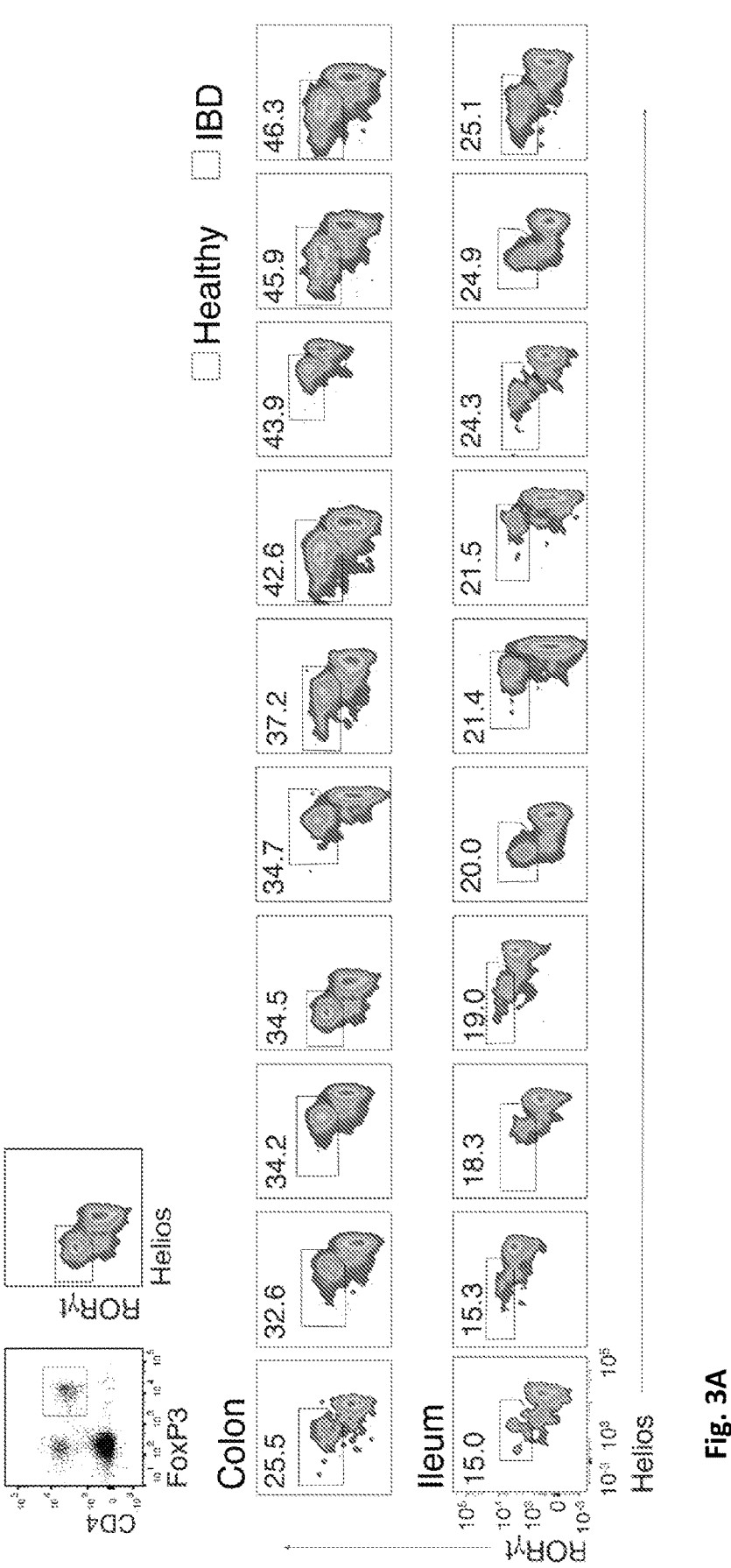
Figures 3F, 3G:
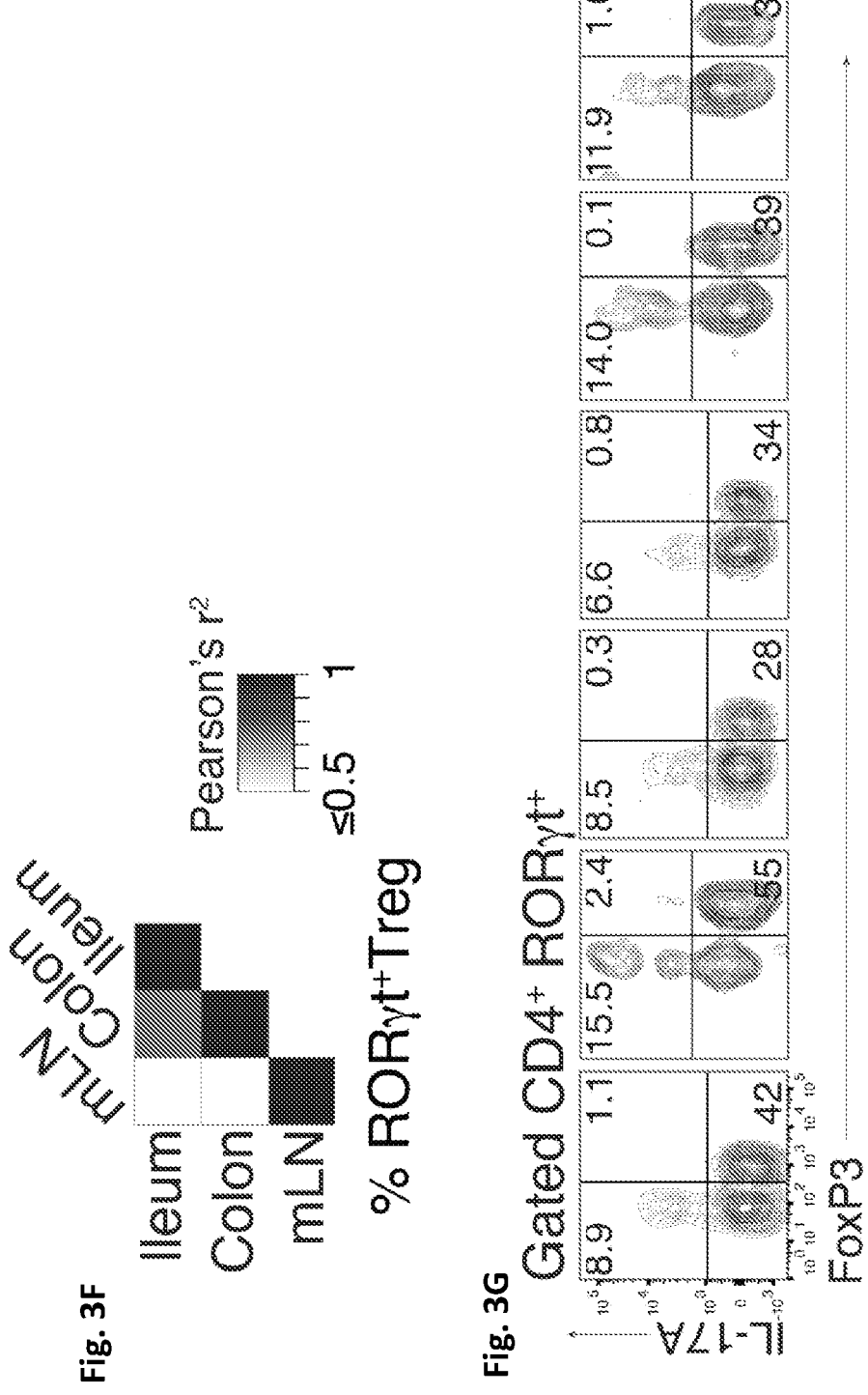

Healthy Donor Microbiotas Specifically Enhance Induction of RORγt+ Treg Compared to IBD-Associated Microbiotas Recently, the gut-specific subset of Treg that co-express FoxP3 and RORγt (RORγt+Treg) was found to be microbiota-dependent, colitoprotective and to regulate gut effector T cell responses. The inventors found that induction of RORγt+Treg in colon and ileum varied significantly with different microbiotas ($p<1\times10$-15, $p<1\times10^{-8}$ in colon and ileum, ANOVA; FIGS. 3A and 3B). In contrast to the total FoxP3+Treg population, the inventors observed a significant expansion of RORγt+Treg induced by healthy microbiotas relative to IBD microbiotas in both colon and ileum (p<0.001, t-test; FIG. 3C). This difference was significant across the two independent cohorts of microbiota donors (FIG. 3D) and in mice colonized with stool or cultured microbiotas (FIG. 10). The proportion of total FoxP3⁺Treg was correlated with RORγt⁺Treg in ileum (p<0.001; R2=0.39) and weakly correlated in colon (p=0.04, R2 128=0.1; FIG. 10D). Colonization increased the proportion of RORγt+ Treg in mLN, but there was no significant difference in the induction of mLN RORγt+ Treg by healthy or IBD microbiotas (FIG. 3E). The proportion of RORγt+ Treg in colon and ileum were correlated, but neither correlated with the proportion in mLN (FIG. 3F). Similar to previous reports in SPF mice (Sefik et al. 2015), colonic RORγt+133 Treg from mice colonized with either healthy or IBD microbiotas secreted minimal IL-17A when stimulated ex vivo compared to FoxP3-RORγt+Th (FIG. 3G).

Whereas RORgt+Treg are assumed to be induced in response to peripheral stimulus from microbiota, a large proportion of lamina propria RORγt-Treg express the transcription factor Helios, indicating a possible thymic origin (Ohnmacht et al. 2015). The inventors found that in the ileum of mice colonized with IBD microbiotas there was a greater proportion of Helios+ Treg relative to mice colonized with healthy donor microbiotas and, as expected (Sefik et al. 2015), RORγt+Treg and Helios+ Treg were inversely correlated (FIG. 10). A lower proportion of FoxP3+CD4 T cells expressed neither RORγt nor Helios (FIG. 10). This 'double negative' population was enriched in the colon mice colonized with IBD microbiotas relative to those colonized with healthy microbiotas (FIG. 10B). As previous described, FoxP3+ GATA3+ Treg were not microbiota-dependent, and they were not differentially modulated by healthy and IBD microbiotas (FIG. 10C). Cytokines secreted by type 3 innate lymphoid cells (ILC3) play roles in the maintenance of mucosal homeostasis, including Treg induction. The inventors found no significant difference in the proportion of IL-17A+, IL-22+ or Csf2+(GM- CSF+) ILC3 in colon lamina propria of mice colonized with healthy or IBD microbiotas (FIG. 10E).

It has been suggested that RORγt+Treg are uniquely positioned to regulate Th2 responses. Although the inventors observed a significant expansion of Th2 (GATA3⁺ FoxP3⁻ CD4+) cells in the colon of gnotobiotic mice colonized with IBD microbiotas relative to healthy microbiotas (p<0.05, t-test; FIG. 1I), the proportion of Th2 cells was not correlated with RORγt+ Treg (p=0.09, p=0.9 in colon and ileum, FIG. 10F). The inventors also found no correlation between the proportion of RORγt+Treg and RORγt+158 Th or IFNγ+ CD4 T cells (FIG. 10F). FoxP3-crexRORγt-flox mice, deficient in RORγt+Treg, show increased lamina propria dendritic cell (DC) activation. The inventors examined whether the deficit in RORγt+Treg observed in mice colonized with IBD microbiotas was sufficient to influence DC phenotype. In B6 mice colonized with healthy and IBD microbiotas representing the extremes of RORγt+Treg induction, the inventors found that a low proportion of RORγt+ Treg correlated with increased expression of CD80 and CD86 on CD11c⁺ CD64- DC and CD64⁺ macrophages/monocytes (FIG. 10G).

Figure 4B:
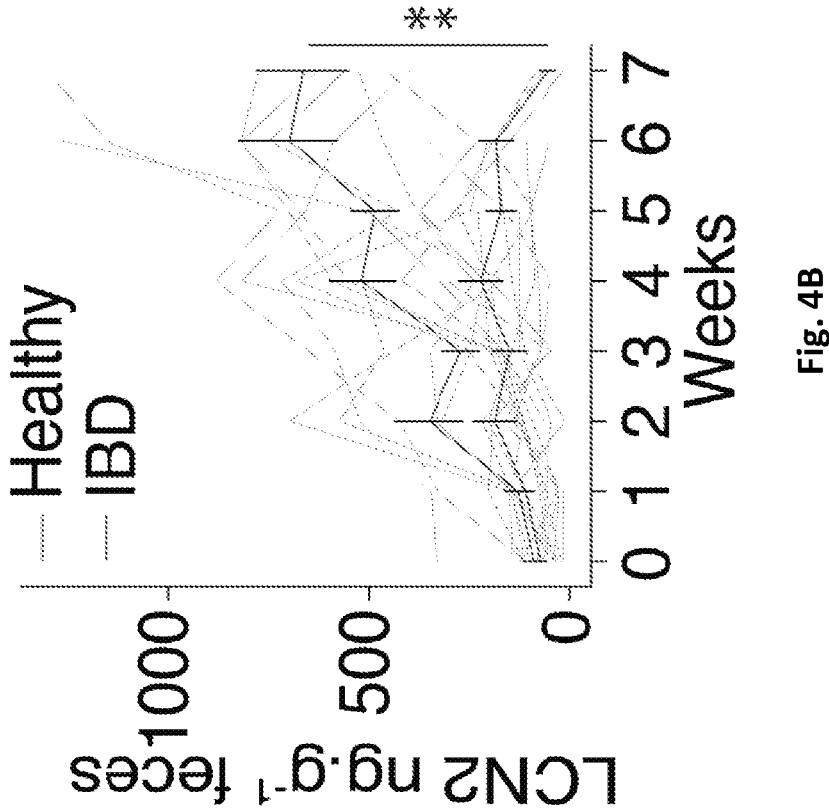
Figure 4A:
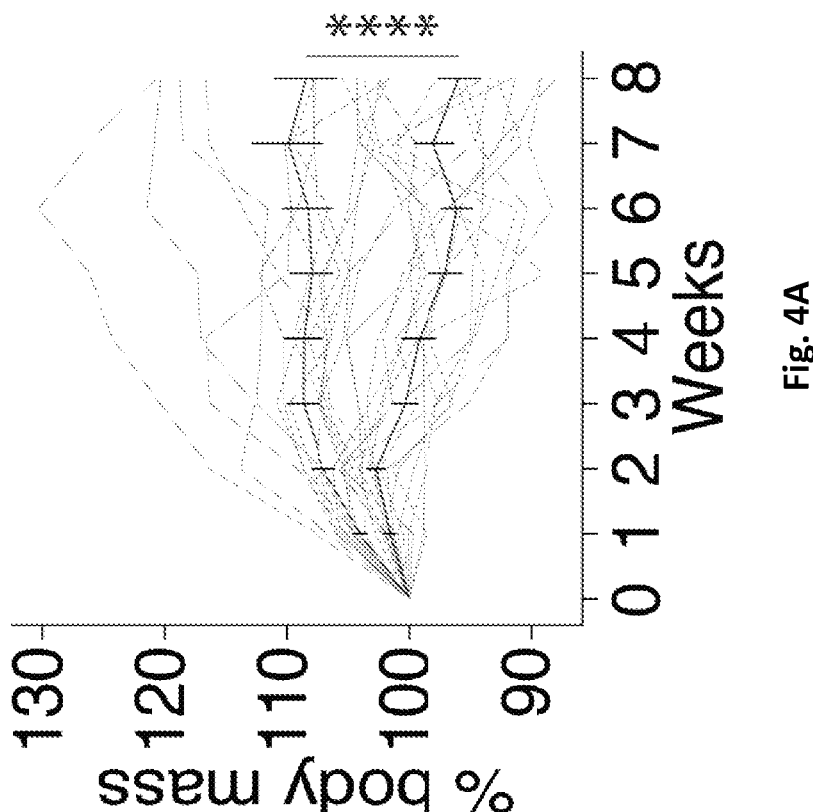
Figure 4C:
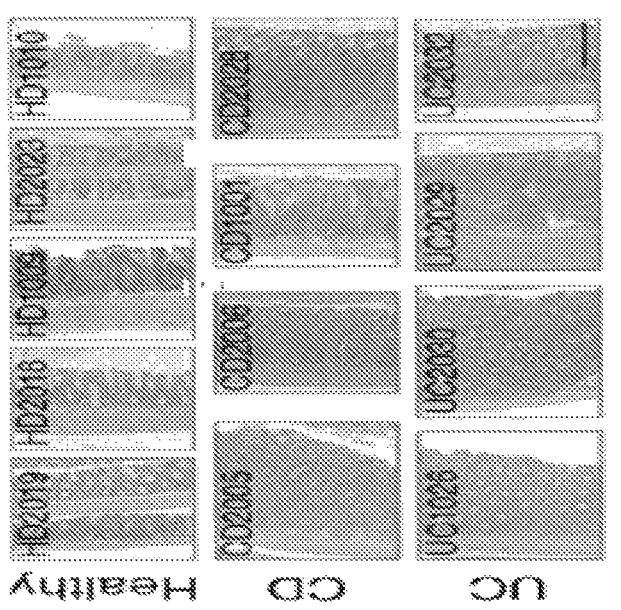

IBD-Associated Microbiotas Transmit Enhanced Colitis Severity to Susceptible Mice To assess the extent of IBD-associated microbiotas influence on colitogenesis, the inventors tested healthy- and IBD-donor microbiotas in a gnotobiotic mouse model of colitis. Given the known importance of T cells in IBD pathophysiology the inventors chose a model of colitis that is both T cell- and microbiota-dependent. Transfer of CD45RBHI (naïve) CD4 T cells to Rag deficient mice induces colitis-like pathology, but only in the presence of an immunogenic microbiota (hereafter the Rag T cell transfer, (RagTCT) model). Four-eight weeks prior to T cell transfer, the inventors colonized germ-free Rag1-/-mice with fecal microbiotas from both healthy (n=16) or IBD human donors (n=14; see Table 1). The alpha diversity (Shannon) of microbiota from B6 and Rag-/-colonized with the same human donor microbiota were significantly correlated (r²=0.6, p=0.002, f1test), an indication of similar engraftment between the mouse models. A control microbiota included in every iteration of the colitis model demonstrated low inter-experiment variation (FIG. 11A). As measured by loss in body mass, histology, and elevation of fecal lipocalin2 (LCN2), colitis was more severe in mice colonized with fecal microbiotas from individuals with IBD than those colonized with microbiotas from healthy donors (p=4.2×10– 5, p=0.0058 at day 42 for body mass and LCN2 respectively, t-test; (FIGS. 4A and 4B). Loss in body mass was correlated with elevated fecal LCN2 (R2=0.33, p=1.4×10⁻⁷; FIG. 11B).

Figure 11C:
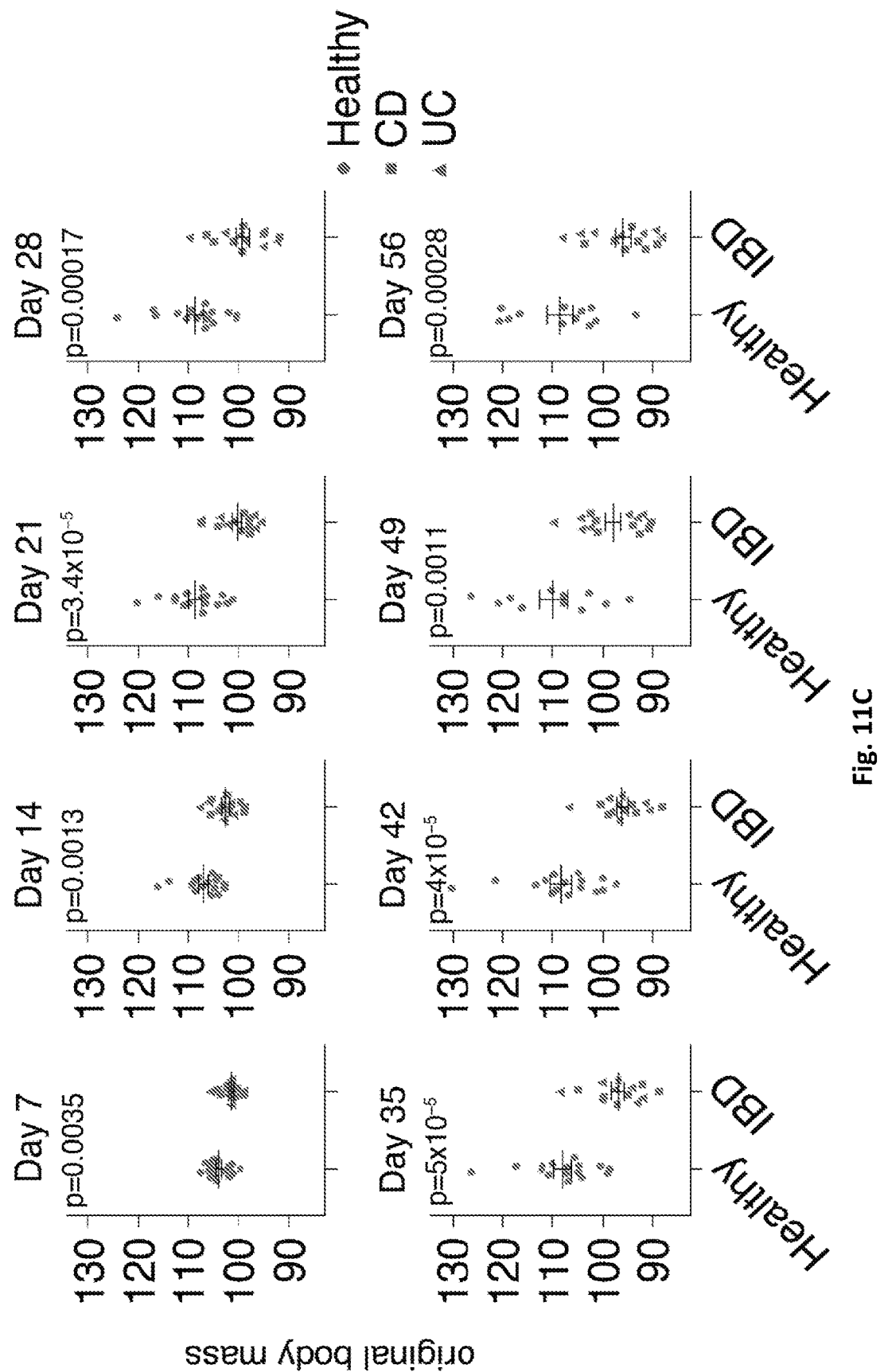
Figures 11D, 11E, 11F:
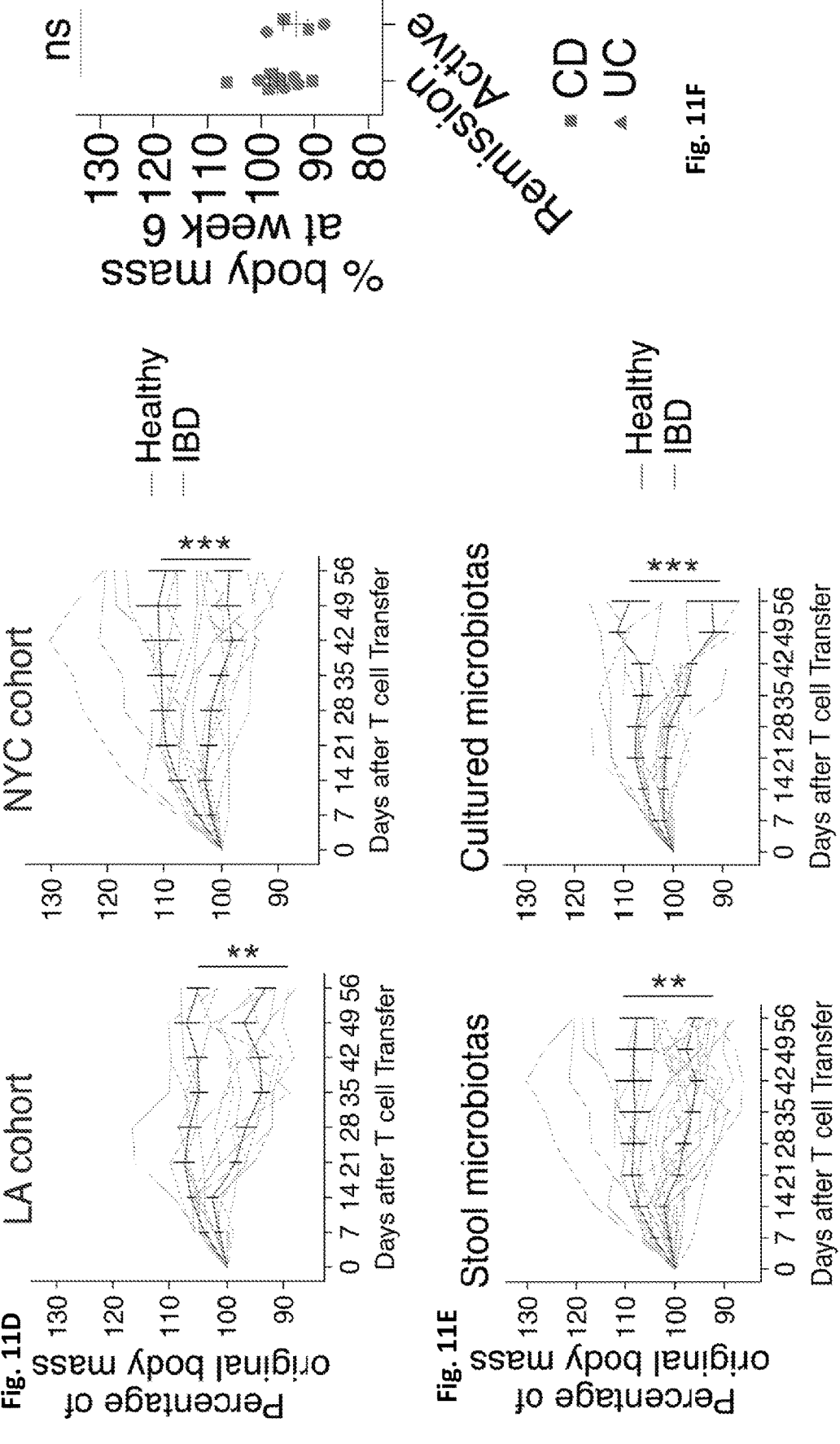
Figure 12A:
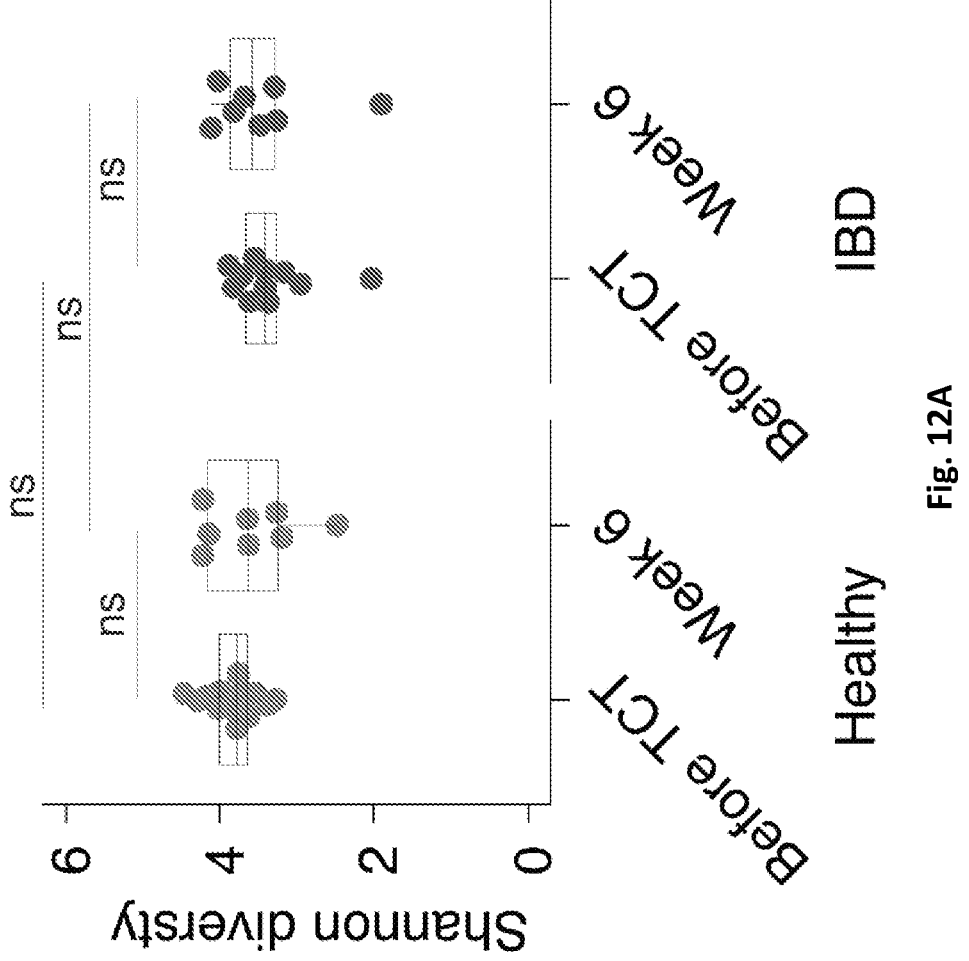
FIG. 12A-B. The figures show that the gut microbiota relative abundances are stable following colitis induction.
Figure 12B:
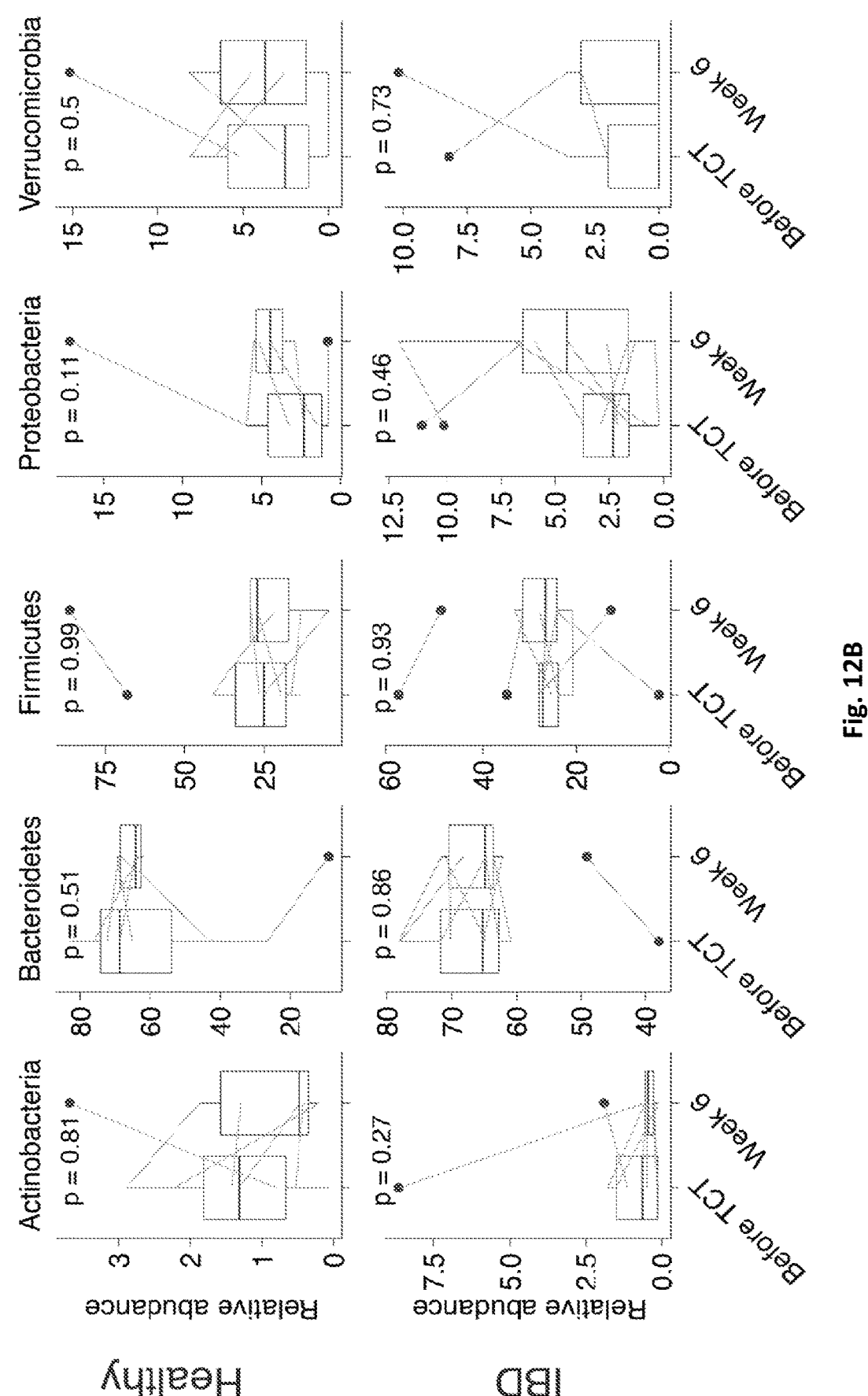

The inventors discovered that a significant difference in weight loss between healthy and IBD microbiotas was already detectable 7 days after T cell transfer and became more prominent over time (FIG. 11C). There was no significant difference in colitis severity between mice colonized with microbiotas from donors with UC compared to CD (p=0.59, t-test; FIG. 4D), and CD and UC microbiotas each independently induced colitis that was more severe than in mice colonized with healthy donor microbiotas (p<0.01, p<0.001 for UC and CD respectively, ANOVA; FIG. 4D). The inventors replicated these findings in two independent cohorts of donors (FIGS. 4E and 11D). The inventors also found both stool microbiotas and cultured collections of microbes from donors with IBD were similarly able to increase colitis susceptibility in mice, relative to healthy donor microbiotas (FIGS. 4F and 11E). Colitis was equivalent in mice colonized with IBD microbiotas from donors with active disease or in remission (FIG. 11F).

Figure 11G:
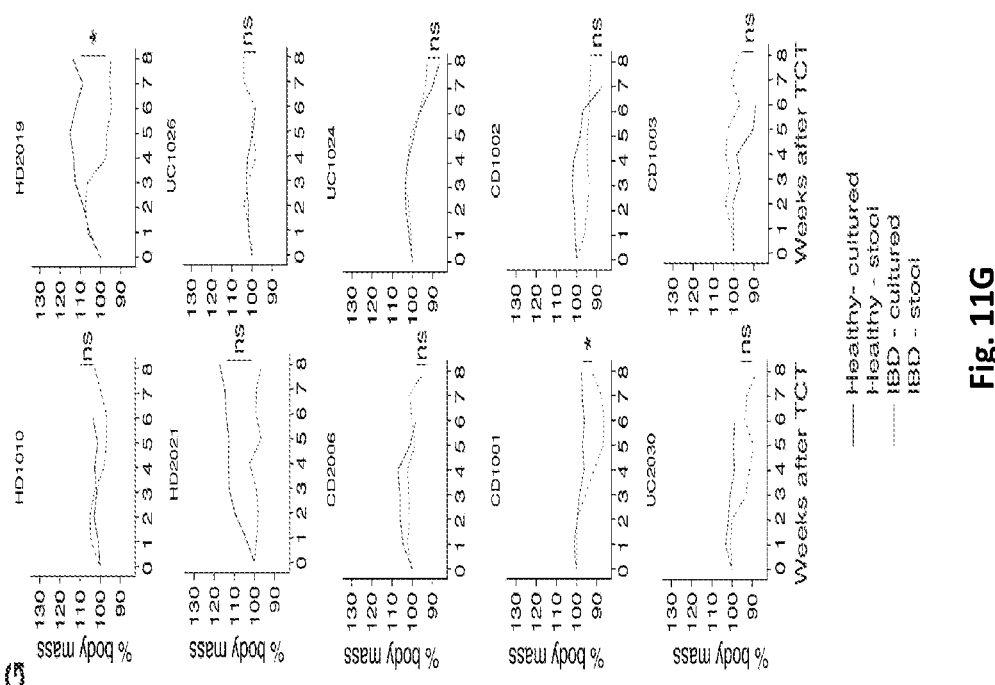

For ten donors, the inventors assayed the colitogenicity of both the stool and the cultured microbiota collection derived from the stool. Eight of the 10 cultured microbiotas transferred colitis of equivalent severity as the total stool microbiota derived from the same donor (FIG. 11G). Based on 16S rRNA amplicon sequencing, the inventors observed no difference in the alpha diversity of the engrafted healthy or IBD microbiotas or their broad taxonomic compositions, either before or after colitis induction (FIG. 12).

Figure 4I:
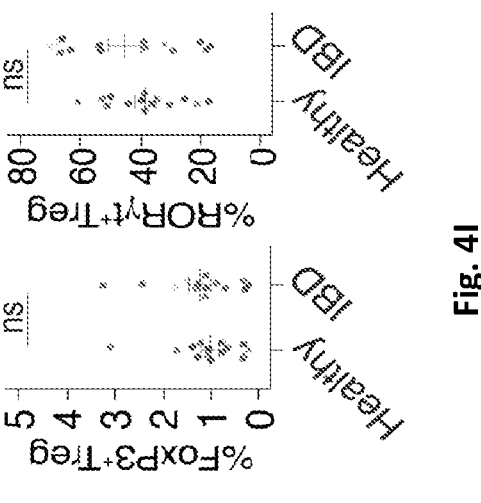
Figure 4H:
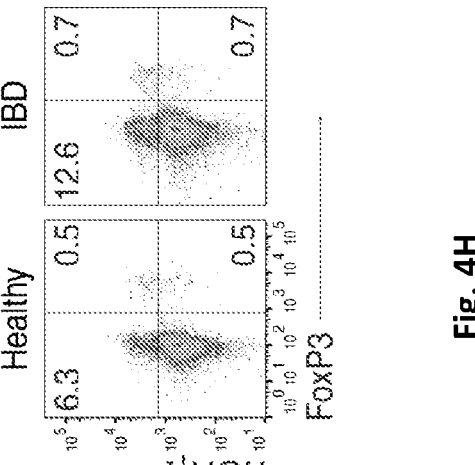
Figure 4G:
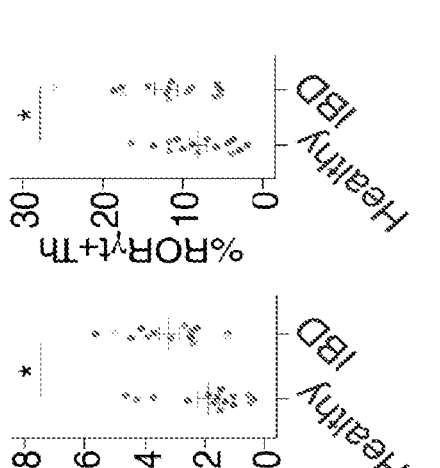

Within groups of mice colonized with one of five healthy or six IBD microbiotas, the inventors characterized the activation and differentiation of the progeny of the transferred CD45RB^{HI} T cells 4 weeks after transfer. Interpretation of immune population variation between these groups is complicated by the microbiota-induced variation in disease severity 4 weeks post-transfer. It was previously demonstrated that exacerbation of colitis in mice is associated with an increased proportion of IFNγ-IL-17A double positive CD4 T cells. In line with these observations, the inventors found the same population expanded in T-cell transfer mice colonized with the IBD microbiotas (FIG. 4G). The inventors also found an increased proportion of RORγt+Th (FoxP3⁻) in the colon of these mice (FIG. 4G). As previously reported, between 1-2% of the expanded cells in lamina propria expressed FoxP3 (FIG. 4H). This proportion was not significantly different between mice colonized with healthy or IBD microbiotas (FIG. 4I). It was notable that an average of 40-50% of the FoxP3+ cells co-expressed RORγt, indicating that the splenic origin of the naïve T cells did not hamper RORγt+ Treg development (FIGS. 4H and 4I). However, the proportion of RORγt+ Treg was highly variable between animals and there was no significant difference in the proportion of RORγt+ Treg between mice colonized with healthy or IBD microbiotas (FIG. 4I).

Figure 5A:
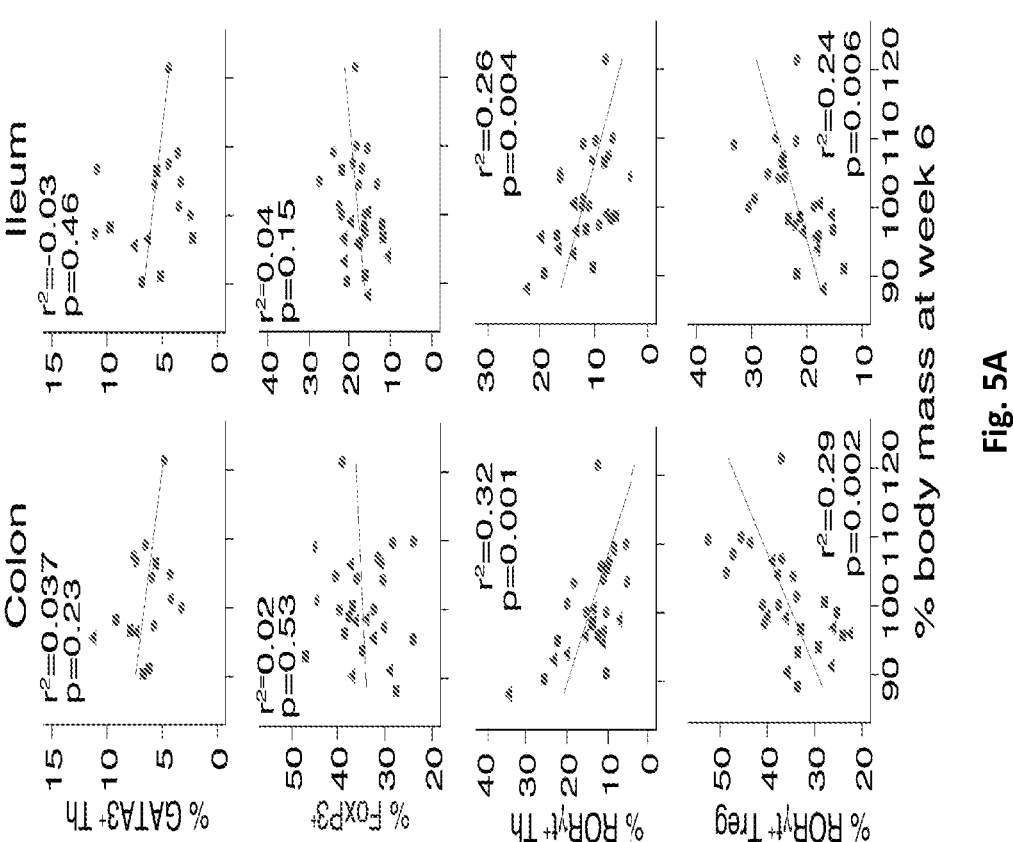
FIG. 5A-B. The figures show that homeostatic induction of RORγt+Treg and RORγt+Th predicts experimental colitis severity and human microbiota donor health.
Figure 5B:
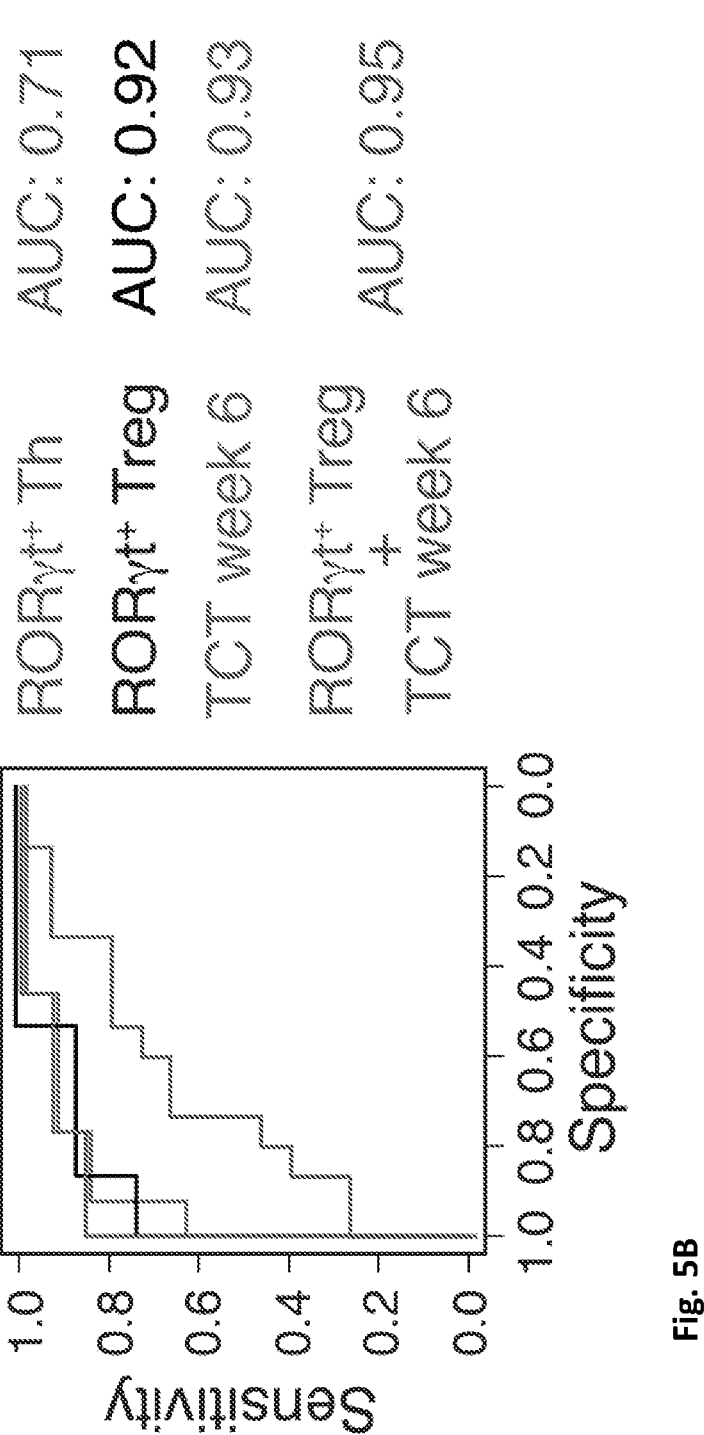

Homeostatic Induction of RORγt+Treg and RORγt+ Th Predicts Colitis Severity in Susceptible Mice Colonized with the Same Microbiota The inventors examined how the variation in CD4 T cell responses they observed in unchallenged gnotobiotic B6 mice correlated with colitis severity in RagTCT mice colonized with the same donor microbiotas. A total of 15 healthy and 14 IBD microbiotas were tested in both models (Table 1). While colitis severity was not correlated with GATA3+ Th or FoxP3+Treg (FIG. 5A), the proportion of colon and ileum RORγt+Th induced by a microbiota in B6 mice was positively correlated with colitis severity in RagTCT mice colonized with the same microbiota ($R^2$=0.32, p=0.001; $R^2$=0.26, p=0.004 for colon and ileum respectively; FIG. 5A). Induction of RORγt+ Treg in B6 mice was inversely correlated with colitis severity in RagTCT mice ($R^2$=0.29, p=0.002; $R^2$=024, p=0.006 for colon and ileum respectively; FIG. 5A). The proportion of IL-17A+ CD4 T cells induced in colon was also weakly associated with colitis severity ($R^2$=0.25, p=0.013; Figure S5). A linear model explained 53% of the variation in colitis severity (weight loss at week 6) as a function of the proportion of both RORγt+Th and RORγt+Treg in both tissues ($R^2$=0.53, p=0.002; F-test). Colitis severity was not associated with Helios+Treg, IL-10+, or IFNγ+ 237 CD4 T cells (Figure S5). Receiver Operating Characteristic (ROC) curves were used to assess the value of the humanized-microbiota mouse data in predicting the health status of the human microbiota donor using a logistic model (FIG. 5B). The proportion of colon RORγt+ Th had reasonable predictive value (AUC=0.71), but the proportion of colon RORγt+ Treg was more informative (AUC=0.92) (FIG. 5B). Colitis severity as measured by weight loss 6 weeks after T cell transfer was also highly predictive of donor health (AUC=0.93) (FIG. 5B). The inventors found the best predictive power when the proportion of colon RORγt+Treg and colitis severity at week 6 were combined in the logistic model (AUC=0.95) (FIG. 5B).

The inventors demonstrated that RORγt⁺Treg cells reduce disease severity in colitis susceptible subjects as seen in FIG. 6. Specifically, the inventors compared the effects of transferring two different types of microbiota into T-cell transfer mice. Mice receiving microbiota from a healthy individual (having high RORγt⁺Treg levels) had reduced disease severity when compared with mice that received microbiota from an individual with ulcerative colitis (and consequently low RORgtTreg levels). Moreover, this reduction in disease severity is eliminated if the T-cell transfer mice are transferred naïve T-cells that lack and cannot generate RORγt⁺ Treg. In that instance, there is no difference in disease severity between the mice receiving the healthy microbiota and those receiving the microbiota from the individual with ulcerative colitis. The severity of the symptoms are measured by percentage change in body mass of the mice over time.

The inventors have also discovered that providing RORγt+Treg-inducing microbiota as a therapeutic can reduce pathogenesis in mice harboring microbiotas from donors with IBD. FIG. 7 shows that gnotobiotic mice harboring microbiotas from two individuals with IBD (and thus low levels of RORγt+Treg) experience an improvement in symptoms after receiving a cultured microbiota that induces RORγt+Treg. The severity of the symptoms are measured by the degree of weight loss of the mice over time. The inventors have discovered that the proportion of RORγt+Treg-induced by a microbiota is proportional to the density of that microbiota (measured as the yield of microbial DNA from a known mass of stool) in the gnotobiotic mouse. FIG. 7 also shows that microbiota density is increased in gnotobiotic mice harboring microbiotas from individuals with IBD following treatment with cultured microbiotas from healthy donors, and this increase in density is correlated with the increase in RORγt+Treg cells in the colon.

Furthermore, the present disclosure shows that the ratio of RORγt⁺Treg to RORγt⁺Th17 cells in the GI is a strong predictor of disease severity. This is seen in FIG. 8, which shows that the ratio of RORγt⁺Treg to RORγt⁺Th17 cells in unchallenged gnotobiotic mice can predict disease severity in colitis susceptible T-cell transfer mice. The severity of the effects seen in the mice is a predictor of disease status in the human donor.

The inventors discovered that three bacterial communities were particularly effective in inducing RORγt⁺Treg and treating IBD in subjects. These are referred to as Communities 1, 2, and 3 in the present disclosure. The composition of the different communities are provided below.

Bacterial Community 1:

*Bacteroides_dorei*_1001099st1_G4_1001099B_141217
*Bacteroides_fragilis*_1001099st1_H1_1001099B_141217
*Bacteroides_ovatus*_1001099st1_E5_1001099B_141217
*Bacteroides_thetaiotaomicron*_1001099st1_D1_1001099B_141217
*Bifidobacterium_adolescentis*_1001099st1_F6_1001099B_141217
*Bifidobacterium_longum*_1001099st1_H2_1001099B_141217
*Bifidobacterium_longum*_1001099st2_C11_1001099B_141217
*Bifidobacterium_pseudocatenulatum*_1001099st1_G10_1001099B_141217
*Butyricicoccus*_genus_1001099st1_D10_1001099B_141217
*Clostridium*_genus_1001099st1_E2_1001099B_141217
*Collinsella_aerofaciens*_1001099st1_A1_1001099B_141217
*Escherichia_coli*_1001099st1_A12_1001099B_141217
*Lactobacillus_casei*_1001099st1_B4_1001099B_141217
*Parabacteroides_distasonis*_1001099st1_F9_1001099B_141217
*Ruminococcus_torques*_1001099st1_G7_1001099B_141217

Bacterial Community 2:

*Anaerotruncus_colihominis*_1001217st1_B4_1001217B_150727
*Bacteroides_thetaiotaomicron*_1001217st1_G7_1001217B_150727
*Bacteroides_uniformis*_1001217st1_B7_1001217B_150727
*Clostridiales*_1001217sp1_1001217st1_G3_1001217B_150727
*Clostridium_ramosum*_1001217st1_B8_1001217B_150727
*Lactobacillus_paracasei*_1001217st_F3_1001217B_150727
*Lactobacillus_rhamnosus*_1001217st1_D6_1001217B_150727

Parabacteroides_1001217sp1_1001217st1_C5_
    1001217B_150727
Ruminococcus_albus_1001217st1_F5_1001217B_
    150727
Bacterial Community 3:
Anaerofustis_stercorihominis_1001271st1_D3_
    1001271B_150615
Bacteroides_ovatus_1001271st1_H2_1001271B_150615
Bacteroides_uniformis_1001271st1_A10_1001271B_
    150615
Bacteroides_vulgatus_1001271st1_G7_1001271B_
    150615
Bifidobacterium_adolescentis_1001271st1_A4_
    1001271B_150615
Bifidobacterium_bifidum_1001271st1_H11_1001271B_
    150615
Bifidobacterium_longum_1001271st1_B4_1001271B_
    150615
Bifidobacterium_pseudocatenulatum_1001271st1_F3_
    1001271B_150615
Clostridium_1001271sp1_1001271st1_H5_1001271B_
    150615
Collinsella_aerofaciens_1001271st1_C3_1001271B_
    150615
Eubacterium_rectale_1001271st1_F12_1001271B_
    150615
Ruminococcus_obeum_1001271st1_ES_1001271B_
    150615
Bacteroides_ovatus_1001271st1_D10_1001271B_
    151109
Bacteroides_vulgatus_1001271st1_F6_1001271B_
    151109
Bifidobacterium_adolescentis_1001271st1_E2_
    1001271B_151109
Bifidobacterium_bifidum_1001271st1_F2_1001271B_
    151109

Bifidobacterium_longum_1001271st1_A6_1001271B_
    151109
Bifidobacterium_catenulatum_1001271st1_H7_
    1001271B_151109
Collinsella_aerofaciens_1001271st1_C12_1001271B_
    151109
Anaerotruncus_colihominis_1001271st1_H4_
    1001271B_151109
Bacteroides_fragilis_1001271st1_A3_1001271B_
    151109
Bacteroides_xylanisolvens_1001271st1_B2_1001271B_
    151109
Clostridium_1001271sp2_1001271st1
    D9_1001271B_151109
Clostridium_1001271sp3_1001271st1_B4_1001271B_
    151109
Coprococcus_comes_1001271st1_E1_1001271B_
    151109
Dorea_longicatena_1001271st1_G10_1001271B_
    151109
Enterococcus_faecium_1001271st1_G2_1001271B_
    151109
Enterococcus_faecium_1001271st2_G9_1001271B_
    151109
Escherichia_coli_1001271st1_H10_1001271B_151109
Eubacterium_eligens_1001271st1_F5_1001271B_
    151109
Eubacterium_siraeum_1001271st1_C8_1001271B_
    151109
Roseburia_1001271sp1_1001271st1_E4_1001271B_
    151109
Weissella_1001271sp1_1001271st1_G12_1001271B_
    151109
Weissella_1001271sp1_1001271st2_F1_1001271B_
151109

SEQUENCE LISTING (58 sequences)

SEQ ID NO: 1 - DNA, 2027776 bp, Anaerofustis stercorihominis
  modified_base (551446)..(551471): a, c, t, g, unknown or other
  modified_base (636790)..(636887): a, c, t, g, unknown or other
  modified_base (887046)..(887055): a, c, t, g, unknown or other
  modified_base (984232)..(984240): a, c, t, g, unknown or other
  modified_base (992486)..(992523): a, c, t, g, unknown or other
  modified_base (1031998)..(1032092): a, c, t, g, unknown or other
  modified_base (1133119)..(1133216): a, c, t, g, unknown or other
  modified_base (1334394)..(1334511): a, c, t, g, unknown or other
  modified_base (1365316)..(1365450): a, c, t, g, unknown or other
  modified_base (1642602)..(1642733): a, c, t, g, unknown or other
  modified_base (1712474)..(1712488): a, c, t, g, unknown or other
  modified_base (1854071)..(1854157): a, c, t, g, unknown or other
  modified_base (1967895)..(1968008): a, c, t, g, unknown or other
atttaagctggggtgtttttaaaaaagtaataatagataataatgaagacagtaaatttaaaacatattttgaagatatgataaagaattcgggttatgagttcgataattatgaatttatgttttatacgatattagaactcgttaattcaacatgtcacaatgtaattttatataatgaacctgtataccttgatgtattaaagaaatatttatataaagatataaaatctataatagataatcatataattaaaaaagacctttagggtcttttttatatagataagttgttgactacttatttaaaaacatatataatttaaaataagtttttttatttggaatatcaaataaaagtaaagatcaaacgaggtaatatatgaataaaaataaagatgtagttattaaactcgaacacattaataagaaatttggagaaaaagaagcattaaaagacgttacttttaatgtaaaaaaaggagaaattctcggttttctcggaccttcgggagcaggtaaaacaactttaataaaaattcttacaggacaaataacatcggatcttggtatagccgaagtttttggaaaagaatgtataaaacttcaaaacgaagattatgaaaaaataggtatggttcttgatgacagtggtgtatacgaaagacttacatgttttgataatatacttctttttgctgatatttatggtatgtcaagacaagatgttcatgatatttttgataaagtagatcttgctgacgataaatgggaaaaagcgggaaatttgtcaaaaggtatgagacaaagacttgtaatagcaagagcaattttacatagaccggaattgctttttttggatgaacctacaagcggtcttgatcctttgacttctcaaaaaatacataatttattgtttgagcttagagaaaaaggaacgacaatatttttaactacgcataatatggaagaagctacgaaattatgcgatcacgttgctcttcttaacgaaggtgtaattgtagaatacggagttcccgatgaactttgcagaaaatataatgatagaaacgaagttacaatgttattaaaatcaggcgaagaagttatttatcaaaataatagtgaatatgcagataaaatagctaatcactttagaaataatgaagttgtttcaattcattcatcagaaccaactttggaaactgtatttatttcacttacgggaaggaagttaatataatgaataaaactaagagcaaaaataattcgtttagaaaaataaaagccatatttataaaagaatttaaggatgcatttaaaagtaataaaatagtatttatgtttttacttttccctgtttttacgtattttttggcatttgtaatgaaaggtaatgcaggatcaaatcctttaatatttttaatgatgcatatatctatggttcctgttatggttacggctgcattaattgcggaagagaaggataaaaatactttaaaagttcttattttatcaaacgtaagacctatgcagtatttgattggtgtgggaagctttgtttttattataaatataattacttcttgtttatttttacctttattacatttacaacttgtttttatacctaaatttttgattgtaatttcaataggtatgctttgttctaccatattgggggcaattgttggtatgatagttaaaggaggagcaaatatagccgcagctactcttcctgtttcaattgtatttgcgatttttcctttattagcatcaggttctggaaatccctttttggcaatggtggcagaattgttatacagcggccagcttataactataatatttgacgtagcaaacaattttacttttataaggttgttaataatgatattaaatgcaatattcttcttaattgtatttactttggtatataacaataaaaaattatcagattaaaaaaagcactttaaagtgctttttttatactatattgtctattttaaaattaattattttttttaaatcttctatatttacttctacttgatatccaacttttcctgcagaaaatattattgtttcaaaatcttttgctgtttcatttataacagttgtaaaaaactttttcataccaataggagaacatccaccgtgtatataccatgttaaaggcagaagttctttttctttaatcattgatattgatttttcactaacgctttttgcggcttttttaagatttaattctttatttacaggtattacaaaaacataatgctccttgctctttcctactgtaacaagtgttttaaagacttgattttcattttggtttaaagattttgcaacatcgtttccgcttaaaccttgattaggatcatatgaataacttttatagttaatttttttttgagataaaattctcattacatttgttttttcactcataatttacctcttttatataaattaataagtatattataatgaaaatttttatatattaaagataaaattaaatatttatatgctttacaacatttatattttatgttatagtgtatatacacgaaaggaaatttttatgaaaagtaaaggatgttattgtattaattttagaagggctgcaaatagcataacaaaatattatgatgattatttaaaagaaagttctcttactttaaatcagttttctttaataaagaatattttaaaaatacagccggcttcaataagtgatatagcatctaaggtaagactagaaaggacaacagttgtaaggaatttaaaaactttgtttaaggaggggcttatagaagatatttcaaaagaaaacgagagaaataaaaaagttatagttaccaaaaaaggaaaagaagttttggatattgccatacctttatggcaggaggctcaagaaaatattgaaaaaattttaggaatggataattataaaaagtctcttgaaatttttaaagtaatcgaaaatttataaatataatataaaggagataaaaaaatgttttacgaagaaaaacaaatggaagaaaaagctttaatggaaactgctgcaaaaatgtgtgctgctgcaagaacagctccaaaagcaaaaggggttgataatattatcacattggttcttacaggaagtgaaaaaaatgctcttgcagacaaaatggatgaagtttatcttagagagtttggtgaaactgaaggacattatgtaagagatgcgaaaaatttaagagcatcaggtgcagttgttttaataggagtaaagaaagcctatacaggtcttgaccattgttcattctgtggttttaaaaactgtgaagaaaataaaaatcatggaggaagatgtgcttttaatactatagaccttggtatagctattggttctgcagtttctgttgctgctgataacagagttgacagcagagtaatgttttctataggtaaagtatttgaagaaatggattatataaaagaaaaagatatattatggcaaggtattccaatcagtataagcggtaagagtccttacttcgacagagtaaagaaaaaataaaaagacaatgtatattgtctttttttattgtttcgattttcttaaccaatattgatagagaaaatattttattttataatatcttatgtattaatggaaggtttatttatgaagaaaaaatgtgatgaaaatataataaaggagtttaaggattataagaatgttctttctgctttaggggatcaaacaaggcaggctataataatttatatgatgataaattgtgatggcaatggttttagagtaggggaattatctgataaagtatctgtttcaagaacatctatatcacatcatttaaaaatattaaaagagaataaaattgttgatatgagaaaagaaggaacgaaaaattattattatataaataaagaaagcagtagcttaaaaaccttaattaacttatttaaagatttggaagaatatattaaataaaggagataaatatgaaaaaagtaaacaatatatattttagtcctacattttctacaaaaaaagtcgtagaaacagttggaaataccataagtgataatacttttaatttagatttatcaaaaaaagacgaagattattcaaagtatgaatttaatgaaaatgaaatttgtgtagttggagttccatcttttggaggaagagttccttcaactgcaagtgagagaataagtaaattaaaggcaaataatactccttgcataataattactacttatggaaacagagcttatgaagatactttaatagaacttaaagatattctaagtagtgaaggatttaaagtttttgccgcaatgtctattgtatgtgaacattcaataatgaatgaatttgcaaaaggcagacctgatgaaaatgatgtaaatgaaataaaagattatgctataaaaataaaagaaaaaattgaaagtaacaattttgaagaaattgaagtacctggtaataatccttataaaaaatatggtgctattccaatggttccaaaagcagataagaactgtataaaatgcggtaagtgtgcagatgaatgtcctgttggtgcaattgattttaatgaacctgataaaacagataaagataaatgtatttcttgtatgagatgtataaaagtatgcgactataatgcaagaagtttaaataaagttatgttaatggctgcaagaaaaaaactaaaaaaagcatgtgaaggcagaaaggaaaacgaacttttcatataataatggataataaaaaaagatgtaagtgggtagatttaaaaagcgaaatttatatagcttatcatgataatgaatggggtgttcctgtttatgatgatagaaaactttttgaaatgcttattttagagtcttttcaagccggtctttcatggataacaatacttaaaaaaagagaagcatttaaaaaagcatatgataattttgattataataaagttataaattatgatgaagataaaataaatgaacttttagaaaataaagatataataagaaataaaaacaaaataaaatcatcaatatcaaatgcaaaaatatttgtaaaaatacaggaagaatacgggagtttttctaattatatatggtcttttacaaatggagaaataataaaaaataaagatgataattttaatacaacaagtcctctttcagataaagtttcaatggatttaaagaaaagaggaatgaagtatgtcggaagtactattatttattcatatcttcaagctattggaataataaacgaccatgaaatagattgttttaaatataaaggttaagaaagttattctttcttaacctttttttctatacattctaaatcataaatacttggagaataaataatatttcccatataatcaaatcttgaaccgtgacatggacagtcccatgttttttcatcaggattccacgaaagttcgcagtttaaatgaggacatttgcttggaactatataacagtttccttcttcgtctttatatactcctactttttctcctttatattctactattcctccatgacctaaaggaagagcttgtaaggtagtatccggaatatttaaaaattcttttcctattccttttattgaataaggaccttctttaattatagatttttttattccttttgtatcaaatctttcgggagaaaatatactgtctttataatcaaaccctttaagtatcatatcacttattatatttgcagcaaccattgaagatgtcataccccatttattaaatccggtaattacataaatatctttaaatgcttttgaaaataaacctatataaggtactttgtcaattgtcatacaatcttcacttgcataatgccctatttcttcaaagcctggatataatttttttatttcttctcttagattttgatatttttctccttttttgttttccccgcttctgtgtttttctcctccaaacaataatatatcgtcgtaacctctaaaagagtatcctttttcatccacatttaaatatatatcttttaatttttttgtattttttaaaattaaaaagtatgaaagttcttggtgcattcttaaaaaataatatcccggaacatttaaaaaaggaaaagaacatgcaaatattattttatttgcttttattttgtatccgctgtctgtaaaaagagtttttcttttagcttttacttcttctataaaagtattttcgtatattgtaaggtcttttaatatgtgttttataaatttaaatggattgaattttccttgatttttatattttattgctcctttgaattttaaaggaagagagctttcttctatatactcgcagtcaatatcgcattttaaaagagcattatattcttttattaatttgttttcatcttcttttgtatataaataagcattgcatttttcaaaatcgcattctatattttcttcttttattatattctcatattcttctattgcttttttatttaaatatgcatattctcttgctttttcagtgccaaagttgcttattagttcttcatatataagtgaatgcgcaagagtaatttttcccgttgtataagccgtagttttttggcatattctgtctttttcaaaaataactgcttttattccttgtttttttaacttataagcagtaagaattcctgatattcctccccctattattgcaacatctacatttatgtttttatttaattcttcatacatcggtaagttaacggtgttttcccataatgaattcataataatacctctaaatctattttttatatattattgacaattataggaaatatataaggtcgaaaaataaaaaataagaaaagctgttttacaatttaagatttataataaaataatgaaaaatttatatataaaattttaattatatatacaaaaacatattaaaaattaatataatataataacccaataaatatcgaaaggatttaaaatgcaggaagaaaaacttgtttcatatatgttggatttgggggaaatgcttttgacttctggagctgaagttagtagggtagaggatactttaaacagaataggaaaagcttatttattacaaaaagtagatatttttacaataacttctactattattctgactgttaaattttcagatagtaatataattactcaaacaagaagaataaaaaaatatgaaacaaaccttgagcaagttgaatatgtaaatcagttatcaagagatatatgtgtaaaaacattaagcattaatgatttaaaaaaagaaatagataaaataaggaatactaataaatacaataaaaaacttatatttctttcttatgtttttgtctcaggcgctttttcagtatttttcggtggaagtttaatggatagtattgcttccatgataaccggaggggtaatgtattttacggtaaatgcattaaataaacttaatataaataattttgtaaccagccttctttcttcactaataaccgctctttgtgctgttgttttaaacagtataggtataggtgaaaatatagataagattattataggaaatattatgcttcttattcccggtcttactcttacatcttcattaagagatatgataaacggggatattatttccggtcttcttggagttttggaatcaattttaaaggcaatagctattgcaatgggttttgcttttatattaattcctataggaggttaaaatgttacaaggtattatacagataattatggcggttataggttctcttggttttgcgattttatttaacataaaaagagataaactttctattataggtattggttctgccataggctggatttgttatttgtttttctttagttttaacgcaaataaagttataactctttttataacaacaaccatactctctttattttcggaaattttagcaagaaaaataaaaactcccgttattgttcttttggttccaatacttatacctttaattcccggaggagatttatactatactatgtataatctggtaacgggcaatatggataaatttatatattatttttctcttgtaatgaaagaagctgcggctatatcttttggaataatcattattacgtcaataatgcagatatttacaaaatttcaacgatataaattaaaataaaaaatcatgcttatgcatgatttttttatatttgtcttggtattttttttgttttaaatattaaaatcaacgttataataaaagtcgttatttcagcaaaaggaacagccatccacattccgtttaaatcaaagaataaaggaagaatttttaaaaacagtattaaaagtataaaggatctaagagatgttataaccgctgagtattgaccttttgcataggaagtaagtcttactgccgtaaaaatactaagtcccgagaaaaagtatcctatggaatatattctcattcccattacacctaagttgtatacatttgttccttttgttgcaaaaaatgatactgccaaaggagcaaatataaaagatattatatataaaacacttggtataatgctaaaaaatctatatgaatatttttccagtttaataagtacgtctttatttttatttccataattataaccaagaagcggagatatacccattgaatatccggtataaataccaaggaaaataaattgtacgtacattattatagaaacagcagcaacaccgtcatctcctgcatatgtaagagctgttttattaaaaacaacagttgtaattgctattgcaagctgatttataaattcagaagaaccatttataatgcaaggaggtagaaagtttaattttattttttctattttaaattttatattattactatattttataaaataaattattcccaaaatcattgaaaggataagtccaagtattgttgctattcctgccccaaaaattccaagtgacattttacctacaaatatataatcgagaataatatttaaaacacctcccgatgccgaaactataaaacttatttttgggtttccgtcaattcttataaaataaacaaaaatttctttaagcataatggctattgttccaaacagccaaatttttatatatatcttacagtaatctaacgttatacttgttgcaccgagaaaaactaatatatccgataaataaagaagtattacccaggaaataataattcctattattaagcttgaaacaatacaaaattgaaacatttgatttgcttttgttttgtcgttttttccaagatatatagaagaaagagaacttcctcctaccgcaaacatcattgcaattccggttaataaattaactattggatatactatgtttattgcagcaagtgcatttgttcctacatattgtgaaacgtatataccgtctactattgtatataaagtagtaaataaagcagtaagatatgttggtattataaattttaaaaccttatagaaatttatattttttatatccttaaacattaaaatatttttcatttttccacctcgaagtaaattataaagtttaaacatagtttaaggtcaatggtttttatgataaaatatattaaaacttttaggagaataaaaatgaaagatgttttttcaataggagatatatctaaattttttaatattccaacttcaacacttagattttgggaaaagaaggggttattgtctccaagaaaagaagataataattacagggaatattcccttcctgatttaatgaaaatatccgatattgttttttataaaaatttgggaattcctttaaaagatattttaaatttaaaaaataaaaatattatagaacaagagtttttttgcagtgaacatttaaaagaacttgaaagtcaaaaagcattgattaatagacaaatacaaagattaaaacaacatcaaaaagctttaaatataataaatgaacttaaggataaggattatataattgctgatatagatactgaatgtattgtatcctttgaacttacacaaaaagaaaaaataaaaatgtatataaaaaatccatatttatattccagagttcaacattcaaatgctaccgataaagaacaaaggggaataaccgtaataaagccgaaaaataataatgatattatatggcagaaaaataacgataaatatgccgtttgtttgatgaaagaagaagtagtaaaagattatccaaataaccttaatagtcttttatcaaaagtacagaaaaaatacgaaacagggtatattataagcagatttttaacttctgcaagggaagaaaataaaatatatgatttttataaaacttatattgaaataaaaaaagagattgattaatctcttttttatttatttagaagatagtttgccgtattttcatctgttattaatttattaacatatccgcttttaactgcaagataaattgcgaacattttgctttctccacctgcaacagctattttgtaaggtacttttttataaacatcactgcttattcctataattctgtcaagtatatctaaagctccttcgttaccgtctctatctaagaatattgaagaaacaatatcgcagcatatatctctttgttttaattcttttaaatcttcatctttaaagtatcctgatttatgtattgttgcattgtcgtctgcaggattaccaagagatgttataacgcagtctaattttttatacatatcgaatacttcttttattgaaccttcatttattattatgtctttgaattttttattgtctactatggaaggcgcaagaagcaccattgctttactgccgaatacttcacctatttttgcggtaatttgatttgaatgacggtctattgatacattcccatatcctccaagaagagaaacaaaagttttttcagggtattttatgtcactttcaatattaatatgacttaaagtgtttccccagcctatacctatattattatattttcttaccatatcttttaactcttcaccggcaccgtctgcaagagaacgagttaattttttactgtctttaaaatatggaacaactttaaagtctacattaggatatttattttttaatgcttcctccaaatcgtttaaaggagtaaattcttttatttttatttcgactattccttcatctatacatcttttaagtgctcttgatattcctattcttgaaatacccatgctgtcccctatttgcttttgggtcatgccgtcaagatagtacatttttgctatttttgaaagggtattattatctaacatttttttctcctaaaattataaaagtggttgacatataaaatcttttattatataatacggttgaaattgaacatatgagcatttaaagtgttcatatgaacaaataaatattaacatatcaattaagtgatgtcaataaaatataaatatttttaagtttcttaggaggaaaaaaaatgcaaggtaaaatgaaagctggcagacttcatgctatcaacgacataagatgtgacgaagtggatattccacaaataaaagatgacgaagtattacttagagtatactgtgcaggtatatgtggttctgacttaggtagagttttctcaacaggtacatatcacttccctacaacactaggtcatgaattcggtggtgaaatagttgaaatcggtaaaggtgtaaaagaccttgacttaagagaagaattaaaagtaggtcaaagagttgacgtaaaccctatgacaggatgcggaaaatgtaaagactgcttaaatggtaatataaatttatgtgatacatacggctacacaggttcaagaagtgacggtggttttggtcaatacgttgcagtaaaagctacacaatgttatgtatgtcctgatgactttagttgggatatgatttgccaaatcgaccctgctgttatttcattacacggtgctttaagagccggtatcaaagttaacgatgcagttgtagtattcggtacaggtcctgttggatactatatggtacaatgggcaaacatctgcggagcaagaatggtaatcgcagttgacattaaagatgaaaaacttgatttaattaagaaagtaggcgctacttatacaattaactcattaaatatgacaaatgaagaagttgttgcaaaaattaaagaatatactggtgaagatggtcctgaagtatgtatagaagcagcaggttctcctataacatttaaccaagcattacaatgcttaaagaaacacggtacatttacatgtataggtactccacacggagatgtaaatgttcttgataaatcttatgataaatgtattttaagaaaagaacttacaataaaaggttcttggtgctataactttacacctgaatatgaagaattctgtgcaacaatagatgctgctaagaaaggtttacttgacttaacatcaattatttctcatagatttaaagttgatgatgtaaaagatgcatttgaattaattgaaagaaaagaattctttaacaaaatcgtaattacacaagatggttacgaacctggaaaatagtttttaattaaaataaaatataaataaaatttaaggagaaaattaatatgttaacaaaatacgaattagcaagagcaaatgaccactctttattaaaaccacaattaacttatgatgaagtaagaaaaggaatccaattcgcaaaagaatggaaatgtagaactgtatgtgttactccatcaagagtaaaaatggcttatgatattctaaaaggttctgaaacagcagtatgtgcatgtgttggtttcccaaacggtgcagaacttacagaatcaaaagttgctgatactcaaagagtatacaacatgggtgcaacagaagttgatatcgtacttaacgtttcagctttaaaatcaggtgattatgatacagtatttaacgatgttcatgcagtagtaaatgcttctcctgctaatatcaaagttatcttagaaaactgcttattaacaaaagatgaaatcgcaaaagcttcaagaatttgttctgatgctggtgctggatttgttaaaacatctacaggtttctcatcaggtggtgctacacttgaagatatcgcaatcatgaaagcaaatatcgatacaacaagagttcaaattaaagctgccggcggtatttcaacagttgctgatgctgaagcattcttaaaagctggttgttcaagacttggtatttcaagaacacaagctatgtttgatgaaattgacgcagcaagcaaataataacttacatttttcctaatatataaaaaaagaagagaatattttctcttctttttttataatatatcatttatagcagtttttatgtcttgttttaataatattgctctattttgtatttgtaatggaatattatcatcttggttattaattgaacaataaaatgaatttttattgttaaaggtcatttgccaaaacggatattttataattgatggtgtattgtatccaacaccgagttctaaaaataaaatttttttatctttatttttatttagaaaattttcatatcttttatatgctttattccaaccttcatcttcaacaaaagtatcatcttgtcttaaattcattgttaaaggtttattacagtatggacatttgggaattaaatatgaaggtattttcatatctttctgctctttaaccatttttattacttgctctttattgtcaaatgtttcattatgacaaggtgtagagcattgaaacaaaccataatcaccttgtgtataaaatagtctggttttatcaattcccgctttttgaaataaatggtctacatttgttgtaatcacaaaataatctttatcttttaagatttttaaaagattactatacgtttcattatcattatctttatatctattaataaatatatatctgctccaaaaagcccagtattcttctagtgtatcaaatggataaaagccgcctgagtacatatcctgtatgccgtattttttatgaaaatcagaaaaatatttaaaaaatctttcttttgaataagtaaaacctgctgatgaagaaagtcctgctcctgctcctaccagtataatatcaaaattatttattttttcttttacaattttaattaaatcatagtagttttttgtatatttcatagtcttttgatttgaaaacatcaaatatcacctcaattgttgattttgtttcatctaaatatttaataactgtatcaacggcaatcttagctgctatatcatttggaaaatgaaattctcctgttgatatacaacaaaatgcaatagattttaatttatatttgtcagcaagttttagacatgaagtgtaacatgatttaagagtttcaatgtcactatttttaagtatattatctatataaggtccaaccgtatgtattatatatttacatggtaaattatatgcttttgttatttttgcttttcctgtcggttcttcgctttgttgtatattcatgattttactgcattctagtcttaattgaattcctgcttttgagtgaatggtattatctatgcatttatgacatggtataaaacatccaagaagtgaagaattggctgcatttactattgcgtcaacttctagtttagttatatcttcttttattaaatatatatttttctttaaaggttttaaatttgttatattaattatttcttgtttttttaattcttcatttagatattcatcttgaatttttaaaaattcttttgctatattttttgcaggacgaatattcattagagagcgaagtaggattttttgttcatcttcatatcttggtattttaatatttttataatcttctttttcgtttaataaatagttaattaaatattttcttctatcattttgattcattttttcctcctttatatataataaataattaatataaaaaaataaagtaggcacttttttgtaatatggttactttttagaaactaatatcattatttaaataaaaaaaaagtttaaaaacttgcttgatattgctattttttaattttttgttttttctaagatattttaattttcgattttatcattaaatataataattaatttctcttattcgttttgctttaataacttacaatgacttcataaaattttctatatctaatcatattaagttatatataatgtcgttattatacctgttattattcagttttatattaaaaaatatttatattaaaaaataaatgtataacattgttttcatcagatgtatttggagtattgatatttttatctttttcttctttagtattgttgttatcacttgtatttgtatatgctgttgtttcaataacagtatctattggtattatttctgagtaaaatccgttatattcaagttgtactgtgagattgaagcttcctttagttcctttaacattatcttttgttccttcttttgcagaagtaaagtctaatattgttacgtttactttcatcccattaggtaaaacaggttttatttggttttccacccatgtttttgcttgttgttttgttttaacttctgatattgatgtcgtttttaattcatccatttccataattttcattaatgtaggatttaataaattaagagcttcgtcttggtctttaacgaattgtaattcatcaatttttcccgcaatcatatcggttattaactcatgtccatatgcatttggatggaaatcaaggtttaaatttaatggagcttcgaagcttgcattgcatggattttcattagcatcattaaatctttcatatacatctgcaaccgcaaatgttgaagagcttgtatttactttcttaataacttgatttaattgttgtactccttgttcaaaagttgtatttattaattccaatgtggttgccatggcagttccttgtccttgttgaggaaggaatttatatggattatactgtgttgtaataattatccatgcatcaggattatttgtttcaatataagagattatatcatttaagttatctttaaaattagaaagggcggtttttgcttgtggtgaatccatgaacgtactaatttttcctgctgcaaataaaattatagttaaatttccattattaagctcttcttttatataatctccgttatatgaagttgcattttcagagttatattcttctgccaaaaaatcatacaaggcattcattaagtcatttccgcctattgtaagtgttattacatcggcatcttcgatatctgattttaatgaattactgtttagtttatcaagcaggctttggcttgtttcgccattgtctgccttgtttgttaagttgtatccgtatttgtctgtaatctgatcaacgaagccgttttgtgacaaaccgtatcctgttgatatgctgtctccaagtgcaaggtagttcttttcgcctgccgcttttatttcattaggtataaatgaaattacaaggaagaaagcaagggaaaaagataatattttttttattaagctgtttttcatgtatgtttctcctttaattgaaaatgatgattttatgttgataatattatatcttaaatgaaaactttacacatcctccgtttttaaacaaaaatgggggataaaaaagattattttttattatttataaatatactttttctttatatttttatggcttgcttatattattttattattagctattatttgttttactttgattttaattttatttaattattaatatcattttcatttacataaatttttgtatgtttaatgtaattaatattttttgttttttcatccttttttattaattttttataatgttacttttattaaaaatatggctatattacccatttttatgcgaaaatgtaggatatgaaaaatcctatttttttggtataatttattaaaagatatacattattttttaatttagaataatatttttaatatatgttttataggtattttttgaacactgattataaaacatttatcctattaaaaaagtataggaggatatttatatgaataaattttctaagaggttaattgcattattggttacattttctttggtactatccatgatggcgaactttaataactctgttgtgttcgcttcttctatggaaaataataaaatcgaaacagacatagataataataatcagacatcaaataatggtaatgtgtctattgtgaagaattctgataattcttctaacgtaaatattaatgcttattctgatacaaaatattcttctgaaataacgaatgtagaggttgatatttctaataaaaccatgatcatagagtggtatggtcaggcaagtaaagttgttattgagttttatgatgaagaatttgacggtgaaaatgatgcggcttctcatttgatttcaaggaagacacaagatgttacatcttctgcgacagagattgtaaagactaatgtttcatatgaaaatgacagttctattcctatgtattttatattaaaaatttatatgcttgatgaaaaagggaacgttgcttcttatgattttctttctaattcatatactaaagatatttatgaacttaggaacatgaccgcagaggattataaagacgagggagatcgtttaattgatgttgataaggttgcaagcgatgatgaagaactaaaagataatgatacttttatggttcttaaggatgatgttattttaataaaagaagaaagtgcttctgaagaaggaactgatagtttacaggttaatattgttcctacaaatgatgaaaactctcttatgttttcccttggaaatgttgattctaaacttgctgatgagttaaataatatagagggaaaaactcctgtttttgtaattgataaatcatctgaatcttctggtgtaaaaactaatttttatatgcttaacataaatagtgcgcaaatggatgatgcaaacggtgcaattatttatggggaaaatttgaatgcaaacacagatgagggagaagtcgaatattctaatttacaaactatatttgaagcttataaaggacatactgaaaaagagtattcaacttccttttctttacctcttggtgcttatggaacaataagtgcaaaaccacaagggaaaataacctttgaattatgtattgattttggtaaaagtaatatatgcgcaatttcctttgaaaatgacttgcattgcaaagatactgaagttgacatagattcaccttctgtgttctttgatattcctgttcttcaagttccaataggcatgcctggagtaatagaatttgatattggcattaatgccagaatttcaggaagtgcaacaggcggtgtaagatttgattatgatttaaattcaggttttgaacttggaatgacaaataagggaaaaacatttttaaataataagtctaagggaagtgatactaagttccaaggatttagtcttacaggaagtgtatttacggggtttgcttttggtgtttcttttgaaataataaaacttatttcgttaagcgcagatcttgcatccggctttgatatttcaggaactttaaattcagggcactactttgaagaagaaaaaatatatcatgcatgtaaagattttgaatgtattgacggagaggtaagtttaaaacttctgggatatagcttttcaattaatttgctcatgttcagtagaggaatttcgggagatattcttccgcctcaattgatatgcaatttatattactccggcacatacaaaacatcaggtcaaacggagtgtcctcataaaggatataagcttaatgttcatgtagtagatcaaaatggtaatagtttatccgatgtagatgtttcatatcctaatgatgataagcagtttgaatctctaaaagaaggaaagaccgatgctgatggtaatgcagttatatatgttcctgaaggaacttatgatattactgcggatttatataaaagtaatttaaaccatcatttttcttcggttgctagttttgttgaacaaggatttgatgaagaaaacggggatttatataattcagaatttgaaattacaattgacatgagttataataccgtttctttccatgatttaaatcaagaagggaaagcaagcaatatgcccggcaatgtttatacatatccagaaagtacctctacggtaattcctgataatacgcctacaaaagacggtcatattttccttggatgggatactaatgaaagttcaaaaaacgtagtatataaaccgggagataaaatagaggctacgaatgatataaggctttatgctgtatgggcatatgattcatataatgttaaatttgattccaacaaaccaaaaaatgcttcaactgaaatgtcaggaagtatgtcagacatgactttaaaatacaatgaaagtaaaaatttaagtgtaaatgcttattcacttccaggatggagctttaaaggctggaatacaaaagcggatggaagcggagatagttttaccgataagcaggaagtaaaaaatttatatggagcaaatgttaaaaatattacgttatatgcacagtgggagccaaagacttatacggtaacctttgatgatagagaaggaaatacaaaaactcaagaaatggtatttgatactgctgaaaaattagatccttgcacctttacgaaaacagataatatatttacatattggtcaacccttgctcttggaagtaagtatttagatgaatcttctgtagtaaatttatgtaatcttgatagtaacggaaatcctacgggtataacgttatatccaaactgggttatgtcagacagtgcagtaattttaattacggataatggaaaatcggtggatacaaataatccagaaaatgatattactttaataaattataataccggtgaagagtttaacggtgtatttgaacgtatggaaagcggagtttatgcaatatctgatactgctgctatacctgagggaacctacaaagttagattcagcggtgcattggaaggatatgatacagatgatagaacaatagaagttgatactttaggtggagcatataactttaattattgtactgtaagcatatcttcagacgagcatgcaacctcatggatagaatctaaaggaaatacaacgaaagaaaaaatcttagttggaacgcagattgaaataggaacagatgtagatgaaggatacagctttgaaagttatactgctgttggaagtactccaggatttgaaaaggatgatcctacaaaggctaatcaaactataaccgttacaggtgaagttcaaattgatgctcatcctttggcaaatttatatacaatccagtttattcctaactttgaaaatggcggaccatcaataactcaggatatggtatacgatgaacctcaaaatctatttgaaaatcaattcgtaagatatggatatgaatttgcaggctggactgagggcgaaaaatggagcggtgaagaaaaattatatgccgatatggaaagtgttaagaatttaacatctgaaaatggcggtaatgttaaattatacgcacagtggaatcctgttcaaacatttattaaatttgatgctaacggcggtgacggttcaatgcttgatcagaccacttattatgaaaataatactaaacttgttccatgtgaatttacaaaagaatattatgactttgtcggttggaatacaaaagccgacggaagcggaacttcatatgctgatgaaacagaatttatttctaataatggagaaaaaaattctactattacattatatgcacagtggaaattaacggactataacatagaatatgatttaggcggaggtaccctttcaaaggcaaatccagttacttatacatatgaaacagattctttcaaacttaataatcctgttaaaataggatataacttcataggctggaccggttctaacggagatactcctgaaaaggatgttacggttaagaaaggttcaagcggagatttgaaatacactgcaaactgggaaccaataactcttactataacctttgaccctaacggaggaacctgggctgacggttcaaaaggtaagaaagtaataactgccgaatatggaagtacaattacaatacctgatgctcctaagaaaaatggtgcaacttttgaatactttgaaggttctaataacaaatacagttcaggtcaaaaaattaaagtaacatctaatcttgaatttaaggcgcactggtctacaaacagtagcagtgcagcaacgggggataataacgatatttcaggtttaatcttcctaatgactatttctgttatcggtataggactaagtataagaaatattaaaagacaaagaaaaatctaataaaaaacagaacctttagtggttctgttttttaattctttatttttcatcaataattatttttttacactgtttacatatatatacatttattttatctccgtttaatcttccaataattccgctttcatcgtagtcggttttttcccctttttctaattatatgatgtattttacgttttatactaatatagagagcttaattaaaataatataattttatatgtattcttaatgtagtgagaaaataaaaagccataaagctatattttatagtctttatggcttatgttaaaattactcgaactcctaagtgcaaaacagatattaactgatttcgcttaggtgttttgacttaatttaatatacaatgatacatattatcttaattctataaggtacattgacttctgctatcaaatagctatcacttgagtgctatcagatatgatacttattcttccttaattcaaacgctgactcaccaccctctaaaatatcacagatatgttgttgtattcctcgagaatttaaaataccttgttcaatagttccgtcatcagtatacacaggcatattattctctatagcacctgacctgtattcaaatctaaattttttatttggaacattacttccttgctgattagctacaattacttcttcagcatctgctccaagaactacatttgcattatgtgtaacaattataatttgtctatctttttttttctttttgatgaatggaattaagtctttgaaaacagatcgattgtccagatcatcctctggttgatctataagaataggacatttactgtctgctaagtctattaacaactttaacaaaaccagagcttttttaccgggggacataacatcaatggtatcattgtccatttgaacattatacttaatctcaaaccaatcatcgcaaatatctctaattacactttccttattgttgccttttttaggttgtagctgatcattaagaattttacaaataatatcttttaaaaagtcctgcgaatactgagcttcagtaaactcatcgattgatatcgtttctttaaagattatagagcgattatctaaaagttttgaaattttatccaaaaatgcttcttttttgaaaggcacacatacagaaaactccaaatcgctacttctgaactcaggcttcgaattaactgtttcagcatactctgtatggaattttttgaatttttctatacacaaagaaatatcattaatatatttattttctttttcaacaagacttttttctttttcctctaacattttcagcttttttaacttatcattttcttgttgaatattgtttgatatttctgtaatcactttattatcttgaattttagatttcaagctatctcgtatttcaaatagttcgttttgtcgattttctttttcatttaatccagtagatatgttggttagtatagtgtgtttactgctttcccaaacagcatctgcagcttctattgctttgttcattgttatatctataagatttttagtatcacttgaaaaagaataattgagttttcttttttccaccaatgaatctatttcttctaaaaaagcaaggtcgtttttcaataataagatttgttctttgagtgtacttatttcaaaaacagttttttcatataaatccaaatcatatttagataaatcaagttcatttgacaatatatcttttctagaagatagtttttctatttgagccttgatagcttcttgatcacctatttcttttttgtcctcttttacgctatttatttctttgtgattttcaattaatccaagaatactcatattcaatgtagacttatagtcttttattgactgcaacatagaagtataagttgacttagctttagcatcaatccaaacaatatcttgaattattctatcgatttctgtagtggattcttttgcgtcacttaatctatttaagtaggtttgaggaatatatacaatcttgcgaggttcgtctttttttccatctttccaagttacaaaaatgttttgaatattcttattaatagaagaggacttctcttctttttccttaacctgcaatgggtctattgcgttagctaaattatgtaatagtatggatttacctgttgatttgccaccaatgatacaggttaaattttcattaaaattgataggtgcgtcctgaaaatctttatctatgaattctactttatcgataacataatactcagctttatagtcaggtaatgtctgagaaattttaactcgctcttcaggttcataaaggatctgctttagaccattaaatgttggatctgcttttatccagcaatatttttgctggtctggttcaaatatttcttcatttttgtgagcatcacttccgtgtacgcaaggttttagtgaaccacactcttttactactgcttcaacagagcaattggatttctttcctaaaaagtatttaatgtcagaaggagtagctgaaaaaataccatcgacaaatttatatattgattgtctaaacgcttttagttgactatctccttgaaaaccatctaagtaatccgaatggtttactgcaccacttacgccatctgtggaactattagaaacaaaaataatagtgttatcacgcagttctctgtcattcaaaaagatttcctgtatcttgtcaaaagatggaacaaattgttctattccttttttatatgctgctgagtcttctaaagttgaatctatggtttttcctaatctaattagttcagagtgagatgccgaaaaagtagttgaactatatctgaaatttatctttgagaaaaacctgctatcaatagagcttataatatcagggttaaatataaaatggatattaataggggaatcattggctattggctgaattctcatttcaacatttggcaatacaagtttaacacttttgggtaatttgttatctgctataactttcttataattatcaatagacaaataatctgttatcgctataactgctactgcttttagtggatcatctccactaccaatatatgtactaatatcttgatagtatttttcccatttttcttcagatgaagacccagtaaaattatcatttttttgagtatctggtgtgtgaatatgtaattcccatcttcgccattcagatccttttgtagattccattccttttgtcctctttaaacaatcttaaaatattttctgttatttggcattaaatccattataacttccaaatccaagcatatacgtagccatcgcaatcgccaaatcttctgattcaacattctgttcgctcgccaaagctctcagctcgtcaataactgtatcgtgtggcacaattgtaccttctaactctttaactgccttttcaataacggatggcaataccatacacatctgataaaaagcatcgtcctgtcctgttactaaggcgtagaattgatcaagacttaccctgcggataagtttatgaccaaccttttttttatcaactgtcgtttcccatttgatattctgagatcgatgtgcaatcgcttctaccaaaaaacaagcacagtcatcgtcatttaacaactgattttgcattttgataaaggttttacctgctgaagcagaattcattgtattatgtttatttttcatttcaacataaacggtatgtacatttcctgcgtcaggaataggaataccatcagcattttcgtaaattacatcccaaccgccttcttcgccatttggcggaacgtgacaatttttaatgtattggaaaatacgctgatgaaaatatccaatatcgttgttgttagacttgtctctttgacggaaaatttcgttacttacaatttcttcccaagaagattgatatactgtcttgtcaaaaattaacttaatcggatcaatgatatttttattaaagcgctttaaatcaaatgattcaagcttttctccgtatttttcaatcgttgctttgacatgatttgaaaaatcttcttcgtttataaaagttaaattccacatcataaactctccaatgcttctcttatttttactgcaatttcatacgctaaattaactggtacagcatttccaacttgtttgtattgctgtcctacacttccacagaattgccaatcatcaggaaaactctgacatcttgcattttctcgtattgtaaatggacgaggctccaatgggtgacaacggtcagtctgtttttggcttggagaagttaaaacagtaagtgaaggttcatctaaacttaatcttcttaaaatacctgttctaccgccttccatataccaacaacttttcatatattctttcgcaatatcttcgggaatatctctccaataaccgcctgggggaacaagctcaaatattttgcgtttatgatcggaatattgtgagccttcactttgaggacaatctaaaagaatatctcttagtactggtttatatttatgaggagtagggaaatgaaatttaatttttggaactaaatcatttctaattccaatcgtaattaagcgttctcttttttgagcaactccgtaatcccaagcatttaagacttgtttttgtatggtataaccttcgctttcaaaaatgtctgtaattgttttatatgtgcgtcctttatcatgtgtcaacaaacctcgcacattttcgaacaaaaacatttttggttggagttgtttcaaaaattttgcgtaatgataaaataatgtacctcgtgcatcttccaatcctaatctctttccagcataggaaaatgcttgacaaggcgcaccacctgataataaatcaagctctcctttttttatgttaaaatactcttccaaatctaaacaagaaatgttagcaatatcatcattgataactcgccaattcggacgattgcattttaatgtatctgacgcagctttatcaaattctattaagccgattgtatcaaatccagctttctcaattcctaaagcaagtccaccagcgcctgcaaacaattcaatagtcattggctttttctcaacaacctctgtcggctcttgaacaaactctactacatcgccaatattacaatttaaagctgcacagattttctctatactttcaaatgacactgtttcatttttgcccattcgagccattacattaaagctaataccggcagcttctttcaattcagtacgattcatatttttgtctatcagtatcttccaaagattattataacaaacagccaccgtgttaatacctccgctataaatattgtctaaaatacaataatggtttgttatattatagcttattttgttgtaaaaaccaagttatctcacgatttcgttagaaattcttttctgccaacacgaactgtaatttattctattattaatactaatcataaaaaatcgggtgcagctatttagctatacctgaaacttttacgcataaattacttttgtattcacaatctgcgttgcacgattacgaatactattcatcttctgcaccaatagtatttgattttcagtttttagctttttctttttgttttcttttttcgccagttgttctaccagccaaagaaacatatcttcagcctgcttatcaatatcggcatggtagttgttcaacttgcagaaaatcaatagattaatatagaaagagcttttatttttttatataccacaaaatctctttgcctcacacacttttactggttttgttcttttttattggtgataggcagtggagataataatctccttgcagcccatactgcaaactgttctttttcatctttataattttaaagcatgaaacatactatttaaattttctttattgatttaaaaataatgaagttacatattatatttattaaaataaaaaaagcattacggactgaaaaaatcagtaatgcttttttatttgaaatattttaaatccgtataaatattagggatttaagttcattgtactactcaaactcaatcgttccaggtggtttgcttgtgcagtcatacagtactctgttgacatgatccacttcgtttacgattcttgttgttactttttgtagaacttcccatggaagttgtgcggcacttgctgtcatgaagtcagatgtcataaccgctcttagtgctatggcatagtcgtatgttctgaagtctcccataacacctactgaacgcatatttgtcagtgctgcaaaatattgtccaaggtctttgtctactcctgcttttgcaacttcttcacgatatattgcatcggcatcttgaactatttttactttttcttcggtaacttcaccgattattctaattgcaagtccaggaccagggaatggttgacgcattaccaaatactcaggtattccaagttcctttcctgcttttcttacttcatctttaaataaatctctaagtggttcgataatttctttgaagtctacatgatcaggtagtcctccaacgttgtggtgagattttataaccgcacttttatcaagtccgctttctacaacgtcaggatagattgttccttgaacaaggaaatcaaccgcaccgatttttttggcttcttcttcaaatactcttatgaattcttcaccgatgatttttctttttgtttcaggatctgttactcctgcaagtttgtcgtagaatctttgttgtacatttgctcttacaaagtttaagtcataaggaccgtccgggccaaatactgcttctacttcatctccttcgtttttacgaagtaaaccgtgatctacgaaaacgcaagtaagttgttttcctactgcttttgcaagaagtactgctgcaacagaagagtcaactccgcctgatagggcacaaagtacttttccgtttcctactttttttctgattgcttcaatggtttcttcaacgaaagaatccattttccaatcacccttgcatttacatacattgtataggaagttatgaatcatctttgttccgttttttgtatgcattacttctgggtggaattgtacagcataaagatttctttctttgttttccattgccgcaacgggacatacaggtgtatgacctgttattttaaaaccttcaggttgtttttttatataatctgtgtggctcatccagcaaacattttcttcatcgattccttcaaataatagggaagaagtatcaagattaacgtttgtgtgaccatattcgcttacgggagctgtggcaacttcgcctccaagtttatgagccattaattgtgaaccataacatattccaaggattggaatgtttaaatcgaagatatcttttgtatatgttgcagaatcttctttatatacactgttaggtccgcctgtgaaaatgatacctttaggatttaaggcttttaaatcatcaagggaaattgtataaggttttatttcacagtacacattacactctctaactcttcttgcgattagttggttatattgccctccaaagtccaatactactactaattcatttttgttactcatattttattttccttaaaattctcttgtatagtttggtgcttcttttgttattgaaatatcatgaggatgtgattcttgaagtgatgctgctgttattttaacgaagtttgcatcatgtcttaattcatcaattgttgcacatccgcagtatcccataccggcacgaagaccaccgataagttgaaatacattatctgctatgcttcctttataagcaactcttccttcaactccttcaggaacaagttttttagctccgctttggaagtatctgtctgaagagttatttgcttgtgacattgctgcaacagaacccattcctctgtatgctttaaattgtcttccttgatatatgataagttctccaggtgcttcttctgttcctgcgaacatgcttccaagcattacagtgcttgcacctgctgcgattgcttttgaaatatcacctgagaatttaataccaccgtctgcgattacaggaacgccgtatttatctccaacttctgcacagtccataacagctgtgatttgaggcaccccgatacctgcaacgattcttgttgtacaaattgaaccaggacccatacctacttttactgcatctgcccctgctttaattaaatcttctgttgcttctcctgttgcaacgttacctgcgataacttgtaaatcaggataagcgtctttaattttctttaaccagtttgatacgtttgtagaatgtccgtgagctgtatcaagaacaagaacatcaactttagctttaactaaagctgcaactctttccattgtgtcagcagcagtacctacggctgcgcctgcaagaagtcttccttgttcgtcttttgccgcatttggatattggattttcttttcaatatctttaattgtaattaaacctttaagtttataattttcatctactataggaagtttttctattctatttttctttaagattttttctgcttcttcaagagttgttccttcaggtgcagtgattaaattatctttagtcattgcatctttaattttctttttaggatctctttcaaatcttaaatctctatttgtgattataccaaccaatgttccgctttcgtctgtaattggaacacctgatattttatatcttgccattatttcatttgcatcttcgattacgtgttcaggtgataggaagaaaggatctattataacaccatgttcacttctttttactttatctacttcggctgcttgttgctctattgtcatgtttttatgaattataccgataccgccttgtcttgccatagcaatagcaagttttgattctgtaactgtatccattccggcacttattagtggaacgttaagtttaattttctttgttaaatatgttgatgtgtctacttgtgaagggataacatcgctttttcttggtattaataatacatcgtcaaatgttaatccttcttttaaaatttttcccatgatagcctcctttaaaatataaaaaaatcgaagatatgttttgcctatcttctaaaatgtaaactatatttaatttatatatatattaatgcaaaaattgatttttgtaaacagtaattttaacaaaaaataagaaaatattttcagtttttccaaatgtttcacgtgaaacatttactgcttttatttatcttattattatatagtatatattttttatttttgctattcatatataataaatcatggttataaaatatttataaattaagttatattttaatattactttgtgtcttatatagcttcatcgtatgatatacagctaattattaactaaatttttttaattttaattatacatttatatatttaatctataatatatatactttcttattaattattttatattagaaaaaaatataatcattttttcattttaatttcatataatatttatgtttatttcttataatatataaaacattaatgtgatatttaatatgaacagtttaaatttactcctttgaaatttagtaatattatgtttcacgtgaaacaatttttaatattaaatttattgaaggggtagtttttctatgttacaatgtgttagtaaaaaaatataggaagaagaatgtttatgactaaaattatatcattatttaatcaaaaaggcggggtagggaaaactacaactgccgtaaatttatccgcttgtcttacaaaaatgggtaaaaaagttttgggaatagaccttgaccctcaaagtaattttacaagcggacttgatatcgatagaacaacattggaaaacagtacatatgatattatagtaaatgaaatggatgcagctgatgttgtaataaaaacagaagttgaaaatttggatttaattccttcaagcatagatcttgcaagtgcagaaatagaaattgcgggaagacctaaaagagaaacaatattaaaaagagggataaaaagcatagtaaataattatgattatgtaataatagactgtgcaccttctcttggacttttacctgtaaatgcactttgcgcttcaaatagtgttcttatcccaattcaatgtgaatattatgcacttgaaggggtaagccaacttatgaatacaatcaaccttgtaaaaaaaggtatcaatcctaaattaaaggttgaaggggtattacttactatgtttgataatagaactaatctttcaatgcaggttgtggaagaagttaaaagattttttggaaaaaaagtttatgaaactattattccaagaaatataagacttgcggaagcaccaagttatggacaaactattgttgattatgatccatcttcaaaaggatataaagcttatatgcagcttgcagatgagcttattaagaaaggggaataaataatatggcaaagaaaaagtcaggagggcttggaagaggactttccgcgttgattccgcaggaagatgtggatggagttttttctgaaaatgaagaacgagacataaaacatattgacataaatttaataagagctaatacaaatcagcctagaaaacaatttgataaagaaaaaataaacgagcttgcaagctctattaaagaacatggaattattcaacctttactggttgttaaaaaagatgatgattatataatcgttgcaggggaaagaagatacagagctgccattgttgcaggtcttaaagaaattcctgttatcgttaaagaatacagcgaaaaagaaataagcgaagttgctttgattgaaaatcttcaaagagaggatttaaatgaaattgaaaaagctgtggcttataatgagcttaaagaaagttttaatatgactcaagaagatatcgcaaaaagacttggaacaagcagggcttcaattgcaaatacattaagacttttatctttaagcgaaatagtaaaagatgcaataagaaataatcttatttctgcggggcatgcaagagcgattctttctgtggaagaagaatacagagaagagtttttggaacttattataagtaaaaagctttctgttagggaaagtgaaaaattggctaaagaatttaaaggtaaagaaaaagaaaaacctataaaaaaagaaaagaaggaaaatccttatattaaagatttggaaaacagattatcttttacgttcggaacaaaagtaaaattaaaagataatggaaataataaaggtagtattgtgatagattattattcaaatgatgatttatcaagacttttagaactttttaaaatagaggaaaaataaactatgaataataaagaaacaaaatattttgcaacagctatgttagtaaacggacttcagttattattatgttttataatttatcttgtaagtctgataatcggagtaaataatgtaatcattgcgggagttatgcttatagcggaaatgattatatggcttgtatgtggatttaaacttgcggtaagcggtaaaatggataaattctggaagttgtttgtaggtgcttttattgcaatagttcctatcttggtttatacttccattgcttatggagtaagtaaacttgtgcctacacagtcccaaggctggacagagtttttcttccttggcggtccattaatattctataataaaccagttactcttttaatgagtatttttagaggtcatggttatttattatttgcggcaaattatgtcattattactgtttgttactttatcggtgaatttttcggttttgtaattaatggcggtaaaagaatgatgaataataaaaaaagtgctaaggcaagcaaaaaagaaaaaacaccaaaagttaaagaaaaaaagttaagcagaaaagaaaagaaacaattaaagaaagaacaaaagaaaaataaagaattatctattgaagaagatgataatgaagaagaagctaaagactctttagatacagaaaaagaatatgtcaatacagaaaacgaaaataaaagcgctgaagaattaaaagaaaaaaacgaagttgttgaagaagaaacaaacgtaaatgtattaacagaaaaaattactcctgaaattgaagaaaaagaagacagattggcagaggaaattgtaaataatattttaaaggagaatttaaaagagcaaagagcaaaacaaaataaagaaaatgaataatctttgctatttaacaaaatagattatgcttacatggatagatattttaattgtcggtattatattggtatgtatgatatgggggacatttagagggcttgttaaaagtatattttccataataacaattatatgcagttttattgtagcaaaagtttttgcaggaacattaagcatttggcttattaataatacaagaatagaagatacaattcatacttttttaagagtaaataatgttattccggaaagtgtgtcaaatagtgtagagcagggaagtgctaatgtaacagattggtttgcgggtttgaacataggagatattccatcatcgataattcatttttttgaaaatctatggaatagtggttcaaacactgtaagctcgggaggtaatatggcagtagatgcgcttaccgcatcaattgtttcatttatatcttttgtaggtattttaattttggcttacgtagtgttatctttgatagttgaaattttaaatcttgcaacaaaacttcctgttataagaacatttaataaactcggtggagcattgtttggaattgttaaagggcttataataaacttaatactaataagtattatatttgtcatagcgatattcttaaaagattcatctcttaatgttgcactgagagattcgatgtttgcaagttatttttatataggatatatattgttttaagaggttattatggaagaaaaatattatgcggatgatattgtggttatgaaaaaaggtcatccatgcggtgtaaatgaatggaaaataataagaatagggcttgatgtcaagcttgaatgcatgggatgtggaagaataattacaattcaaagaaataaatttaataaaagtgtaaagaacaaaaaataaaaggatatcgattgatatcctttttattttagtgttgttgttttttctttaatgtaattgcagttgtaattccaataattgaaatcataaatgtaattacaaataatgtcatatttgaattgtcacttgtttgtggtgaaagagttcctgcattatcatttgtattattatctgttgatgtagaacctgagctgcttgaagaatcatctttatctgttggaggtgttgtgatattaccacctgtatttaggttttcatcatttataataacgttatttcctgaactattaattactttaacattttctggtatagaaagttttgtgttttcaggaacagctagaagttcaatttcatcacctgattttaaattattaattgcttcattaaaatcttcttctccaattactgttttattgccaatttttgcactatattcactgtttaccttaacattatcaccaagtttttgaaggaaagttccacctgttatttcaattttatttgttcctgttgaatcaacagtaccatttatagttcctttttgaatgataactttaccttcttctgtactagatacgttaccgttaatatcagtaccattaattgtaattacaggtgattgagaatcatatcctgcacttgtataatttgatgctaaaacttcaccgtttattgttcctccgtttagagccattttaccgccgtttgtagcattaatattaccatttattgttccgttttcaagaataacatttccaccgtcgtaaccgccccatttgtcagaatcaaatgccattcctcctgcagctgcagttatttcactgccaccggttattgttgttgaaccattgttatttgaaacgatatattgtgttaaattgtcagttcctgataatttaacattatcaatagttaagtcgcaataattttgaattaatagttttgctgtttctgatgttatagcaccattttgaattttaactgttgagccttttaataattgaagaccatttgtttcagtacctgttgaacctacagtgtctgtaatatcccatgtaaaattatttaaatcgaatgttatgttttgattttcatttacttttacaccggaacccgtaaaattgtcgttaaatgtaattactgcattagtattgtcctttggaacagctgccaccgcttctgccacagtatcataattttttttgctgtctccaatttggagtgttactgcatctgttgctgcgaatacatttgaaaataaagaacatatgatagcaataatcgcaaaaacagatataatttttttgctttgttttttcattagtttctcctttttattttataattatttttacaacaacttatatatagtatatattattaactatatattttcaagggaaacctttatttataatattattaaagaaatgtttcacgtgaaacatttttatattaagtttagtgtttttaatataaaaagccacatagtcaaagtgaacgagcttaatagtgttgttatcataacggttgaagatgataaaatgccttcatgccccatattctttgccataataaatgagctgactgttgtagcacttccaagcataacaagtattgtaacaagataatcatttctgtatcccatataaacgccgaggggtaaaaataaagcacaaaatactattaacttaagaacagcacatatgattgtaggttttatttctccaactgcctttttaaaatcaaaacttgcacctatggatataagaccaagcggagttgcaagatttgccaagttttttaatgtattatccattattacgggttttgaaagtccggataaagaccataagattccaaataaaatacctaaaattataggattttttagtatatctataaaggtagactttataacttttccatcaagtttttctttatttggtttgaatattgaaagtattataacagcggcaacattataaagaggaactgcgcctataatcattaaaggggaggctcctatgtttccgtaaatgttttgtacaaatgctattccgataattgatgcagagcttctgtatgaaccttgaataaattctccctgtatatttttgttttttaagaataaagatataacataggatatcaaaattgaaataaaagtagctataaagcagaataaaacaaattttgtatcccaaagttcaataaaatcaacactgcttacatcttcaaataaaagtattggaagagcaatagaaaatactattttatttaagcccttattaaattcttcatttattatatttatcttttttaaaaacatacccacaatcataataaggaaaataggtattgtcgcgtttaaactgaaaatcaaactgttcataataacacctcaaagaaaattttaacacattatttttttcttcaagaacatttttattatgtatttgttttcaaattaaacaatgatacatatttagtgattaaataatatttaaagtaattaatatattatttttaaggggaaaagttattactttaaatgttataagtattttgaaatagtaataaagcactgttatgtaatattacaaaatatattaaggtataataaaaaaaagagatacaatattgtatctcttttttatttgattattatactgtaattttcttttcttggttttgcttcttttatttcgccctttgagtaaccaagagataaagctcctatcccaactaaatcatcacttaaattccattcttttaaaagagcttttccttcatctgtattaaacatttcgtattctctgtttatccagcaagttgaaaggcccaaagaatgagcagcaagcatcatattttcaagtgcacaagtaccgtcttgaacatgcgttcttgcatttttgtcagctaaaactattattactgttggagcatcataataaggatttgaatcacttcccataatctctgcattcatttttgcaagttttgttaaagtatctttgttttgtacggccacgataacaggagattgtttgcccattccagaaggtgcatattcacctgattttaaaataagctcaagtgctttgtcacttatttgtgtatccttataacttcttacgcttcttcttgaaagaatattttcaataacctggtttgacatataaatccctcctaaacgtctgttattatatatattttaatacaaataattaatatatacaatatttaagaataaataaggatatatgtaatttgtattagtaacgtttttcaacttcttcaataaacattagagtaaatactataataagtcctattactgaaaataatacggcttttgtgaaaaatatctttgttaaaagacttccaataatagcacctaaaataaagaaacatattattccataatattgaatgctatttcttaataactgtttgtttttggtttgtttgtatttgtataaattttctgttgcacttcttaaatttcctgtgcacattgttgttgcatatgcattgccgtttacttttctaaagccctctacctgcaaagagcatacaaaggatattaatatgttacataaagtgtctaaatttccggaaggaataaatcctacaattaaaagagttataatttcaattaaaataattatttgtctccaatgtatgttgtcgttgtatttatgtcttttctttatcatttctgctgcaagtattccgataaaaaacgcgaatataggaaggaaatagaatccaaccatttgaagatttccttttgatacatttattccaagcaaaactatatttcctgtttgggcgtttgcaaaaacacctcctcttgaaatataagtatatgcatctaggaaacctccaacaattgccaaaatcattcccagcctataggtttcggacatttgtttcttttctgtcattttattgtcttccttagtttatttgtgataggtttcattgtttattattttaaaacttctatatatttgttcaagtaacattattctaaatagctggtgggggaaagtcattttggaaaaggagatttttttatctgcctttttaagtacgctgtcgcttattccaaggcttccgccgataataaaggttatgttgcttttgcctgttattgataaattttctatttgctttgaaaattcttctgatgataattgttttcctttaatatccattgcaataacaaaagagtttttaggaatttttgaaataattttttcgccttctttttcttttgcaatattatcgagagagtcattaccggttagtttctcatccggaagttgaattaaatttaactttacaaatcttgaaagtctttttgaatattcattctcagccataacccaatatttttcttttaatttacctacacatattatattaatattcatcttttttcttccaaagtatttttattaatgtataaatttcattttctttactgcatattttaatgtttgtatatttttgcccgtcttctatcgtatcttttgaatatacaataggtttatcatttatagtaatttgttttttatatgtaacttggattttataaggtagataattacttaaaacatcttcatctacatagtctaagaaatatgaaaaatataaagcattgtttacgtgattgttagtatctaaatcgcagtgtcttatttgaagaggtttatattctacattattaaatagttcgtcatcaattttatcaacatcaaagcctcttcctttttctatatcttcaatgtcataaacatttgctatttcttttgttacttttcttattttaaaagtatctttttcaacgaacagccatcttgtttttgcttctattagaatttttccattttcatcttttaacaaaaatattctgttaccatagaatttattaaatgaataaggatatgtttcaactgttatattatcgcctattttaccaaagtggtatatgttcatatcataatttaaaagtatccaagtaaggtcacttgttctgtctatgccaagtgtttcatcttgttttaaaaatatatcttgaaaccaccttgcagcttccataggttttagtctgttaaaattatcaacgtttgaaaactttattctatgcttttccgttatatatgattttaaattctgcactttatcacctgcttataatatttttttatattatactaccaaaaatataattttcaaataatccttcaaatgtatcatatatatttttttcttgacaaaggtatatgcggtgatataatgattttgttaaaacgtcttgcatccttggtaataacctaaaagaaggagtgagaacggaggtaaatatgaataataaattatttaaagacacaaaatcttttacatttttaagcataatgcttgctttaactatttttttcacttatacggtcggaatgattcctacggggatggcttcgatggcagttcttgcatttttcccaacagttttaacttcacttatatatggtcctaagacgggtgcatttatgggtattttagcgggaattgttgctatgtcaaaaaatatcataatgccatcaggattactttctccttattttattaatcctcttgtatcagttttcccaagaatgtttataggaattataccttattatgtatacagacttttggataaaataataaaacaaaaagatatagtagcctttatatcaggaatgatgggtgctgttacaaatacagcttttgcaatgagtatgctttatcttgtttatgcaaaagatataatagctgttacgggaaaagcttttaaagttgttttgcttggaattattacttcttcttctgtaatagaagctataataatgggtattgcaacttttgctgttttaaaaatttatttaatgaaaaaaaatacaattgcggcaaatataaaaaaagatatataaaatttatatataattataaaaagaaagaaggataatataatgggtagcttatttaaagatacgaagcagtttacatttatgagcataatgtttggaataacaatattttttacttatactgcaggaatgattcctgcaggtatggcttccgttgcaatactttgttttattccaactgttcttacatctcttatttatggaataaaagctggtgcatttatgggggcgcttgctggtcttgttactctttcaagagcaattatcgctcctgcgggaatacttgatccatactttataaatccacttgtatcagttcttccaagaatttttataggtattgttccgtattttatatataagattgtaaaaatattaacaaaatcaaaggctttaagctttttcttttccggtgcctttggggcaataataaatacagcacttgttatgccaatgttatatttaatttatggtacagaaattgccaaagcagtaggaactagtttcaaagttcttttgattggtattattacatcttccatgttgttggaagcatttgtaatgggaatatttactgttgcaataatgatggtatatataaagaaaaatccaaatataaaagtagaaaaataggagagaaaaatgattttagttattgatgtaggcaataccactacacaacttggtatttttaaaaatgataagttaatacatgagtttagatatattacaaagcaagatagaacaagtgatgaaataggaactcttataataacattcttttctcattttggtattaatataaaagattttcaaggagcaattatttcaagtgttgttcctgatgtaaattatcatttagttaatgcaataaaaaaatatttatgtgttactcctatgattgttggtagcggaattaaaacaggtattaacgtaagaacagataacccaaaagaagtaggtgcagacagaatcgtagatgcagcggcagcttataatatatataaatgtcctgttatagtggtaaactttggaactgcaacaagatatgattatgtaaataaagatggagtattttcttatgcggtaacatctcccggtattcaaatatcagccgatgcactttggaaacaagctgcaaaacttcctaagatagaaataaaaaaaccagatagtatacttgcaagcaatactataacaagtatgcaggcaggtcttgtatacggatatatcggacaagttgaatatgttataagaaaaatgaaagaagaattaaacgaagagggaataaaagtcgtagcatgtggaggatatggaaaaataatttatcctgaaacaaatgttatagacgattttgacccattacttacattaaaaggattaaagattatatatgacaaaaacaaaaaataattattttagcaaactttttaaacaaaataaaggaatattagctccaatggcaggtgtaacaaacctgccttatcgtatttttatgaaggaaatgggctgtagaatatttgtaagcgaaatggtaagcgctaaaggaatattttacggaagtaaaaacacatttcctttaatggaaacaaatgaaatcgagcatagggattgtgcctgtggaattcaaatattcggaagcgaccctgaaattatgggtaagataacaaatgaacatttgaatgatacagagtttgactttatagatataaatatgggctgtcctatgaagaaaatcgtaaataatggggacggttctgcgcttttaaaagatcttgtaaaagcaagagaggttactgaggctgttaagaaaaactcaactaaacccttaagcgtaaaagtaagacttggctttaatgaaaaatatatactcgatattataaaagctgtagaagacggcggagcagatatgattaccgtacacggaagaacaagggagcaggtattcaccggagaagttgattatgatgaaattaaaaaagcaaaagagaatgcagatgttcctatagtagtaaacggtgatttggataactaccttaaagcaaaggaaaaaatggattatacaaaaacagatgccgtaatgataggaagaggggcaaattatgatccgtttattttttctcagtttaacgaacttattgaaggtaaggaagttagcgtatataataatcaagataaaataaatgcagcaagaaaacattttgaaattcatatgaaatactcaactgcaaagaaaagcgttgtggaatttagaaaatatttatattggtatataaaaggaataaaaaacagtgccaaaatacgaaacagcataaataacatttttgaacaagaacaagtatatgaagtatttgacagaatagacgatatattaaaagaaggagaataaaaatatgaaaagcatgacgggctttggaagaggtgaatatagaagtgaaaaccttgtaattgatgttgaaataaaaacaatcaatcatcgttacagagattttaatataagacttccaagaagatattcagcctttgaagaaaaaatcagaaaccttataagtgaaaaagtaaacagaggaagaatagatgtatttataaagactgaaaaatttggaagtgaagatgtatctcttcattatgataaagagcttgcaggggaatattatcaaatattaaatcaaataaaaaatgatttccctggggtaaatgatgatatatcaatcataaacattgcaagatatcctgatgtaataaaagcagaagaagcagaaattgaccttgaggaacaatggaaatactttgaaagtaccataaaagaagcagtagatacacttgttgaaagcagaagtgcagaaggtgaagcattaaagaaagatttcgtaaaaagaattaatattatcgatgaacaaaaagaaacaatatcaaaacttgctcacgaaatcccagaaaattatgcaaaagaattaaatgaccatatagaaaaatataaaataggcgttattgattctgataggatagcaactgaaattgcactttatgcagaaagagtaaacataacagaagaacttgtaagactttcaaaccatttaaaatctttcctttcaataatagaaaaaaaagaacctattggaagaaagcttgattttcttttacaggaaattaacagagaagcaaacacaattgcatcaaaatcaaacagctttgaaataagtactgcagttgttgaaataaaaagcgagctagaaaaaataagagaacaagttcaaaatatagaatagtaggagaagaaaatgagaggaaacttatttgtaatatcaggtccttcaggaagtggcaaaagtacaatatgttcacttcttgaaaaagaagataaaataaagatatcaatttcagcaacaacaagagataaaagaacaggtgaagttgacggagtaaattatttctttcttacaaaagaagaatttgaaaaaaagataaaggaaaatgctttttacgaatatgccaatgtatttaataattactacggtactttaaaagcaaaagttgatgaaatgctcgatgaaggatatcatgtaatacttgaaattgatgttcaaggagcaatgcagataaaagaacaaaatagtgaagcaaagttaatctttataatgcctccaagcgaagaagagcttataaacagacttacaggaagaaacactgaaagtgaagaacagcttaaacttagaataggcacggcaaaaaaagagatatcatataaagataaatacgattatgttgtagtaaatgataatcttgaaaaagccgtagaagaaataaaagaaataattttaaaataaaatcgacaaaatagtcggtttttttgtataataaaataaaaaaaggaagaaagcaaatggaatataaaatcagcccatctcttatgtgtatggatttacttaatatcgaaaagcaaataaaaatactaaataaatatgtatattcatatcatgttgacataatagacggagtatacttcaagaatttttcttttacacccccttttatgaaggctatacgaactattacagataaaaagttagatgcacatgtaatgttaatagatccattttattatttagaagaaatggttgaaagcggggcagactgtgtaagtattcacagcgagaaacttataaacgaagcatttagaacagcaaaatttcttcatgatagaaataaagattttggggtagtgttaagtcccgaagcaaaagcaagtgatttggaaaaatatattgaaaaggtagataaagttactgtaatgagcgaagaacctgggtttgccggaggagagtttatttctggaagtcttgatacaataaaagaacttgttaaaattagagaagaaaagaaattaaactttttgattgaagttgatggagtagtaaataaagatcattttagagaatataaagatgcgggagttgatatttatatagtaggaaacagaggattattttctcttgatgatgatttggaaaaagcagtaaatataacccttgaacaaatagcaaaagcataaaaagaacggtactaccgttcttttttaatgtcccgcaggttttctataaagtagatcatgttctttatatgtatccccgtatataaatatagctaaagttattaaaagaggaataatagcaagccatattgatttttcaacaagaaaactacaagcaaatgttaatataaatccacctattacaaagaagaataacatacataaatgagttaagcatttatttaacaatgtatagtcttttttccttatgattcttgacatcgctattcctatttgtcttaaatgattagtgcaaaaagttgtggacattggaatgccttcagcttgtctgaatgtattatactgcattgaagcaataaaattaatggataactgtactatttgatttggaagtgtaagaggaataagccccatgataaaaagaacaattatttcaaaagcgataagatacgtatcccatcgtaaaaatcccagtttttttattggagaggggagagattctgatatgaaagctccgagaaagtaagcagttattggaattaaaaaataaaaaccgtgtgatatgtttccttttccaaatgcgattgccatcattacaaagtttgctgtttgtgcattacaaaacacaccgcctcttagattaaaagtatatgctcccatcattcctgcactgcacatcaaaagcaaatataccagtttcgattcacaaaaaaggtattttgaattatttttttctttattcatattcttacctcaaaacatgttatgttttatagtatagaacagtagcaataaaacttcaagtgttaaagaaatatgattatttcctgggtaataaaaagaagagtcatatatatgactcttcttttgggtaaaattatatattaaaagtaaaaatgatagatatctacataatgttatattttattaaaatatctttagctaccaagtatctgcttactctttcattcattgcttgtttttctatatatttatgtgcctgttcttcattaagcttttcattttccattaaaataagttttgctctatcaacaattttaatttcttctattttgtttcttaacttttcattctcttttttaagatttaaaagtctgtttttaagtgccatttgcattttaaaagcttgataaaacataggctttataattggtttttgaagtacaaaaacccctgcaaattcaacatcagcgcttatttgttcaacaatttcgctttttaccattaaaattgttcctatattgagccttgcaaaatcaaggctaagttgagttcctgtttcttcttttaaaggagtatttataattgcaacagctacttcgttgtttgttacatatcttcttgcctttgaagcagaggatgtcgtgattatttgaacattatgatattcttttaatagttgacataaagtatcttttgctttttcgctatatgaaactatcaatactttatccaaataatcacctcccaatgatatatactttttttactcagttaaaaaatatttaagttcctgaatgtcttcgtctatttgtaaatctttttttcttttattaacaaagttgtatacaagattttctccaagacattcttttacgaatatactgttttcaaaaacgccaagtgctaaactaaaattatctgcaagattatcaaaattttctatttttgtatcttgggtaaaatatttcaaattagcattttcgtttaattcttcttttttcttaataccctctaatcctgcattgattacaagagcaaaagccaagtaaggattagccgtagggtcaagacttcttaatgtaatcttgcttcttttttcaatatagtctgttattttaataagagtattagggttcttctttgaccaagtaattgattttggcgcataaaattccccaaatcttttatatgagtttcttgttggatttaaaattgcggttatttcttttattctgttcatgattcctgcaataaaatattttgcatctttagaatcttcaagtccttttgataaaatattttcattgtctttaaatacaagaagattaagatgaagcccgctgcctgataattcttttagaggtttaggcatgaaagtagcatatccgccgtttttatttgcaattgcttttacaatccatttgaatgtaacaaaatcatctgcagcaagcaaggcttcggagtttctaaatattattctgttttgtccagggcctctttcatgatgagaacttataggagttattcccatttcttcaagagtaaggcaaatttctcttctgatattttctcccttgtcaacaggggagatatcaaaatatcctgcttcatcataaggcattaaagtaggctgtccttcgtcgtctgttttgaaaatataaaattcgcattcagtacctacttttattgtatatcccatttcctttgctttgttaactgcttttgtaagaattcttcttgagtcattttcaaaattttctccatttggatactttacatcacaaaagaatcttgcaacccttccttccgatggtctccaaggaagaattgataaagtagtcggatccggaaataaaagtaaagtattgtttttttcgtttgaaaatccgtctatggcaaatccgtcaaaggctattccgttttcaaaagcattttgcagttcatctgacattatagctatatttttttgaatgccgaacacatcacaaaatgcaagtctaatgaatttaatgtcgttttctttaacgaaattgatgacttcctttgtaatattattcatataccctcctaatgattagtatataattgtttgtatggactttttgtgtttggaattataatataaaatttactttctataatattatcataatctttattaaaataattacaatatttttttatattatcttttatttcctctaaatcttctttttctgcttctttaacgataagtttatcaccttcaaatacaggtgggttatttgttctaagataaattttacccccatgcattcccgttgcacagaaattacccattggaatttctttatcttcatatcccaatcctaatataacgatatttccgcctgcttggtattcaccaaggaatgagcctgttttccctccaacgattatggctggttttttgtctttataggctttcatatggatacctgctctgtatcctacatcaccttcaacaaatattgtaccaccacgcattgcatatcctgtcgcatctccgcttgaaccgtgaattataatttcaccgtcattcattgtatcacctgtcgcatcttgtgcattttcatttatggtgatttgtgcaccgtcaagatatgcgcctactgcatttccaggtactccgtttattgtaagattaactttagacatacctgcacctataaatctttgtcccattacatcatcaatagttatgtctaaatcttttaaagcacaagctttaatctgttcgtttatttgtctgtgttcaagtccttttgccccaaatctcataactttttacctccaagcttagagtctctgtaatctcttgaaaatgccataagtcccggattatctttaactaaatcaaaatctatgtcatttagattaattttttctcttattaaataagtatatattccggctttatctacatctcctatgataatgaaacctttaagaagattatttttatatacaagtttcttatattcattttcattttctactatatattcttcaccgtcgtagtttcctgctgttaccatatgaagaccaaataatccaagagaattcatcggcattgcatttttataggatttttctcctcctgccatgtttactcctgctgtttcgcctttaaagtaagcatttggaagaagtgcaaggatgatattttgatctcttgtaatatcataactttcagtacagtctcctgcagcataaacatctttaattgtcgtcataccatgttcatcggttataatacctctgtttacttcacatcctatttcctttgctaagtttacgtttggtcttacacctaccgcaactacgaatatatcataatcaagctttgaaccatcttttagggtagcttgtttttcatcaattttatcaatactgttaccaagtataaatttaacaccttggttttcaatatgtttttggaccagtttgcatcctttttcatcaagaatacttggtaaaattctatcggcaaggtcaacaacggtaacatttttaactttattgttaattgcttccgcacatttaagaccgataagtcctgcacctaaaattaatactttactgtcttttgtaattgcttttttaagatttaacgcatcatccaaagacataaaagtaaatttgttttctaccttttcttctccttcaatgtgaggtgtaaaaggggaagagccggttgcaatcattagttttttgaaagggatgtttcttttattattaaggacgatacatttattttcataatcgattttttccgccttaaccccttttatcacttccacattgttttttatataaaaatcatcttctctatatctcattttttccaaagttgtctttccttcaacaagataagatatcaaaggtcttgaatagataaaatgattttcatccgtaactaaagttatatcacctgttttatcaacacttcttattccttctattgttccaatggcggcaatagaaccgccgataattacatatttactcataattaacccctttcctcgaaaacaatggcattatttggacatcctttaacacagttaggttctccaaaagaattgtttgtacaaaattcacatttgtttacaacactgttttcttcatcgggatgaattgcaccgtaaggacaaactaaaacgcatgtcaaacatccgatacatttttctttatctacactgataagtccgtcttttattgataaagcaccacttatacagctttttacgcatattggttcttcgcagtgtctgcaagatacagcaaagtgaatttgatctttatcttcaactcttatattaggatagattttctttcctttaagagcttttatcatattgtcttctttactgtttgcaaacgcacagttatattcacataggtgacatccaaggcaccacttttcgttgacgtaaattcttttcatattttattctcctgcatgctttattcctagtatttcaagttctttttcgttaagacctacacctcttaacattaatctgtttccttttagggcttctattgagtttattcccataccgcccatcatttcttttatttcatgttcccaagcggttacaaggtttactactcttttatatccaatatcaggatttaatctttttacaaggtctggtctttgagttgcaataccccagttgcattttccgctgtggcagtttctgcataagtggcagccaagagccattaatgctgaagttgcgatataaacacagtcggcaccaagggcaattgcttttactacatctgcactgcttcttatacttccgccaactacaagagaaacattatctcttatgccttcacttctaagtcttgaatcaacacttgcaagggcaagttcaatcggaatacctacgttatccctaattcttgttggagctgctcccgttcctcctctaaaaccgtctattgcaattatatctgcaccgcttcttgcgataccgcttgcaattgcggcaacgttatgtactgcggcaatttttacgataactggttttttatatccggttgcttcttttaaagaaagaacaagctgtcttaaatcttcaattgaataaatatcatgatgaggagcggggcttattgcgtcgcttccttcaggaatcattcttgtttttgaaatatcaggtccgattttttctcccggtaaatgtcctccaataccgggtttagcaccttgtcccatttttatttcaatagccgctgatgtatcaagataatctttatgtacaccaaatctacctgatgcaacttgaactattgtattttttccatatttataaaaatcttcgtgaagaccaccttcaccggtgttatacattattccaagttcacttgctgctcttgctaaactttcatgagcattgtaacttattgatccgtaagacattgcagagaacattattggaacgtttaatttgatttgaggaggagtgtttggaacaatatttcctttatcatctctttcaatttttacatttttctttcctaagcttacttttgtttccattggctctcttagggggtcaatagatgggtttgttacttgagatgcgtttataagcattttatcaaagtaaatagggtactctttaggatttcccattgatgcaagaagcactccaccgctgtcagcttgacggtaaatgttttctatatgttcagctttccaacttgcatgaggtttaaaagtatgatcgctttcaacgatttttaaagcttttgtagggcatagagatacacatctatgacatgcaacgcagtttgtttcgtcacttaacataagtttgctgtcttcgtcataaaaatgtacttcatttgcacattgtctttcgcatactctgcactgtatacatctgtcttgatttcttaccacttcaaactgtggatgtataaaattaattcccatcttattctacccccttgtttaatgtaactattacaggttcaccaccggcaggtgagtaaattttatctacttgtttttgtattatttttattgcactttcttcacttgccatatatacactttctcctttttcggcaacaaccattgaacgaagttttaatctgtcgttaagagccataagtcctccgttaaagcctaagataatagagaaaggacctgtaataagtagacttgaaaacatagttcttaaatatgaaagtctttctttttctttttcgtcttttgtttttattgtttcccagaaaggagcagcaacaacttcagctgcttcttttaatgtaagtttattttttctaagcaaataatccatcatatatgtaattacttctgtatctgttagaagattacatttatatccaaacatttcaatatatcttctgtttgcatcataagaagatatttcaccgttatgaactattgagtagtcaagaagactaaaaggatgggcaccaccccaccagccgggagtgttggtagggtatctgccgtgtgctgtccatgaatacgctttgtattcatctagtttataaaattcgcctacatcttccggataacctactgctttaaaagaacccatgtttttgccgcatgagaatacatagcagccttgcatatttgtatttatattcataacgcattcaactacaaattctttttcgtctaattgagaagattttagtttagattcttttggtaatacaaaatatctatatattaaaggttcgtttgtgattttatcgatttttctggttggaatgattccttgttcgataatatcaaaatgagtatctaaaaaagcttcacattcttttcttacaatattgtcatcataaaaaacatgaaaagcataataatttttatattccggatatattccgtaagcagcaaaacctccgccaagcccgttgcttctttcgtgcattacttcaattgatgttattatgtctcttccgtcggttcttttcccgtctttgtgaaaaataccgcttatggcacatcctgaaggtattcttacatttccttctttgtatctttcgtcaaatatcatttttacacccccaaaaaataaagcgcccaataagcacataaaaataaagtacttattggacgccgttgtccttaatatttagttagtgttataagtataaacataaaattataaaaatgcaagagaaatttgtattttttttgaattttctaaaaatttaaaaaattaaaaaaaataacttgacaaaaataaatcctcgtagtaaaatccattcatacacagcaaaggcgctgtaagcaaaatgcttacggtgcctttttgtttttaataaggctcttgttagatgaaataattattaaatttatagtagaaacctaaaagaaaaaattgtataattattttatatgcaaaacttattaaggtagatacaaaattaaacatgaaaggatgtaaaaattatgagcggaatacccgaattatttggcagcaaggtttttaatgacaaaactatgcaagaaaaattaccgaaggatacatataaaaaattaaaagaaacaatagaacagggaaaaagacttgatataagcattgcgaatgaggttgcacacgcaatgaaagaatgggcacttgaaaatggttgtacacattatactcattggttccaaccaatgacaagtttaacagctgaaaaacatgatgcatttatcgaacctgacggagataatgttgttttacgtttgtcaggtaaagatttactacaagcagaacctgatgcttcatctttcccatcaggcggacttagagcaacaaacgaagcaagaggatatactgtttgggatcctacaagttatgcttttattaaagataatactttatgcattcctgcaattttctgttcttacaatggtgaagttcttgataaaaaagctccactacttaaatctattgaagcaatcagtaatcaaacaaaaagattattaaaacttcttggaaaagaatgcagcggtgctaatacatcagttggggcagaacaagaatactttattatttcagaagaaatgtataagaaaagacctgaccttatctatacaggaagaacattattcggttcaccttctccaaaaggtcaagaacttgatgaccattactttggttcaataaaagcacaaattttagaatatatggaagatttggataaaagcctttgggaatttggtattaccgcaaagacaagacataacgaagttgcccctgcgcaacatgagcttgcacctgtatattcatcaacaaatacagcaacagaccaaaaccaagttatgatggaaatgatgaaaaaaattgcaagaaaacacgggcttgtatgtcttcttcatgaaaaaccatttgaaggcataaacggaagcggtaaacataataactggtctatcacaacaaaagaaggagaaaatttattatctccgggaaacgaccctaaacaaaacatgcagttcttattagttcttgcagcagttgtaaaagcagttgacgaacatcaagatttacttagaatttctgtagcaagtgcaggtaatgaccatagacttggtgcaaacgaagctccccctgcaattatctctatattccttggagatgacttaaaaggtgtagttgatgcaattatttcagataatgattataagagcgaaggaaaaacaaaattctcattaggtgctactgtaattcctgatttaacaaaagatacaacagacagaaacagaacatcacctttcgcatttacaggtaacaaatttgaatttagaatggttggctcaaaagactctgttgcttgtcctaacatgattttaaatacaattgttgcagatgcatttagtgaatttgcagataaattagaaaaagataattcagaagaagcaatcaaagctttaattaaagaaacatttactgctcatcaaagaattattttcaacggagacggatattctgatgaatgggttgaagaagctgctaagagaaatcttttaaatttaaaaacaagtgcagaagcaattccttattacagaaaggaaaacaatgtaaaattatttgaaaaacataaagttctttctaaagatgaacttgaaagcagaacagaagttttacttgaagaatatgcaaatgtactttcaattgaagcaaaagctacccttgaaatggcaaaaggttcaatccttcctgcttgtatagcttatgtaaaagaagttgcagaaacattacaagttaaaaaggcagtttgtcctttagcaaacagtgatgttgaagaaaaaacagttgtaagaataagtgatttaaatgctaaactatataattcaattaacgtattagaagaaggtttaaatgaagccgataaagttgaagatgcagaacaaagagcaatggcatttaaggaaaaagtatttgataatatggaagaagtaagaaaatatgcagacgaactcgaaacaattgttgacaaaaaatactggccatatcctgcatatggtgacatcttatttagtgttcaataagaatataaattaaataaatcaaggcacaaaggcgtgtatgtaatctttatatttacatacacgcctttttattttatatattttaggaggaaaagaaaaataggaacaacattttctgctcttgatactatttgggtattacttggagcaatattagtattttggatgcaagcggggtttgcaatagtagagggaggttttaccagagcaaaaaatgcaggtaacattattatgaaaaacttaatggattttgttcttggtaccattattttctgggtacttggttttggcataatgatgggtgatgatattggtggaattataggtaaagtggatttctttattagaggaaactatgatagtactttccctacaatggcctttattattttccaaactgtattttgcgcaacggctgctacaattgtatccggtgcaatggcagaaagaacaaagtttattgcatatttaatttactcggctgtaatcagtgcagttatttatccaatttcaggtcactggatttggggtggtggttggttaagccaactaggattccatgattttgccggttcaactgcggtgcatatggtaggaggaatatctgctttggtaggtgcaaagattttaggagcaagacttggtaagtatgataaaaatggaaagagtaaagctattcccggacataacattgctttaggcgctcttggtgtattcatcttatggatgggttggtttggatttaacggttgttcaacagttgcaatgtcaacagatgcagatatggtttctgcgtcaacaattttcgtaacaacaaacatggcagcagcagctgctgcattaatgagtttaattgttacttgggttagatacggtaaacctgatgtttcaatgactctaaacggagctttagcaggacttgttgctattacggcaggttgtgatatggtttctactacaggtgctttctttattggtgcaatcgcaggtgtgcttgttttatttgcagttgaatttattgatcataaattaaaaattgatgaccctgttggtgcaatcgcagttcatggatgctgtggtgcgacaggaacacttttaacaggtttatttgcagttgacggcggtttgttctatggtggtggaattcatatgttcctaactcaacttttaggtgttgcgagtgtagccgtttatgtatttatcgcaatgtttattgtatttaaaataattgataaaacagttggtttaagagctagtgaagaggaagaaatcttaggtcttgacataacggaacacggacttgtaagtgcatatgcagactttgctcctgcaggagatttctattattcattggatgatgaaagtgaagtccttggaattgaaacacaacctacaacagctaaagaagaaataaaagaagttgtacctactactcaaacaactccggttgaagatgatattaaagttacaagacttgacagcggtataagtaaagttactatagtgattaataaagataaatttggagctttaaaagcctcaatgcaaaaaatcggagttacgggtatgacagtaacaaacgttcttggatgtggtgttcaaaaaggaagaaaacatttctatcgtggtagtgaagtagaatctattttacttcctaaattaaaggtagaaatcgtagttgcggcagttcctgtaagaacagtaattgaagaagcgaaaaaagctttatatacaggtaatatcggagatggtaaaatctttgtttacggacttgacaatgttgttaaaatcagaacaggtgaagaaggctttgatgctctacaagaaccagaagaagaataataaaaagacttgtacattatgtacaagtctttttaattacttattaaacatttataaattttaataaaataaaaattccctttgcaaattttttcagtattgtaatatatttcattctccattaaactgtaattaagaaaagattaaggagaatagaatatgaaagcattaatttttaacggaccgaatgatttttattatggggatattgaaacacccgagtgtcctgaaaatggtgtacttataaaagttatatcagttggactttgcggttctgatataagaacttttacttcgggacataaaaaggtaaaacctccttttgtaatagggcatgaggttgcaggtattattgaaaaaagtgacagtgaatattacaaagaaggtcaaaaagttatgttaaatccgggtataacttgtggaaagtgcagttattgtacatcggataaaaatattaagaatcaatgtaaaaatttaatagtgcctggaatgaatttttatggcggttatgctcagtatatggcagtacctgcagttggttcaactcctgaatttttacatattttacctgatgactttaatttagaccttgctccgttatcggaaacattggcaagcgtatattctacacatgattttatcaatgtaacaaaaggggatacggttcttgtaataggggcaggacctcttggaaatttacatagtgcaatggcaaaattaagaggagctaaaaaagttatattatcagaagtaaaccagcctagacttgataaagcaaagagatttgattatatagatgtgttcgtaaacccaacaaaagaaagcttggaagaagtcgttatgagagaaacaaacggagatggggtagatgttgcaattacagcctgtcctgtaggttctgcgcaggaagaggccactcattatctccgtccaagaggaaaacttttattatttggcggacttccacatgataactgccgtgtaaattttgacagcaatttaattcattataaagaacttcaactttgtggaggttatagctttgatcctgcttcttttaaatctgcacttgatttaatagtagaaggaaaaattgatgcaagcaaatttgttactcatacaattcctttaaaagaaataaaacacggcattgaaatgacaaaaacaggggaagctataaaagtaattttaaagccatgggaagaataaaaaaaagagcaggacaacctgctcttttttttggtaaacatgaaaattattgataatagttttgttattttattaatataattataatctattgacaaatggggtataatatattaaaatattatagcatattcacgggggagtgcccgagtggctaaagggggcggactgtaaatccgttggctcagcctacaatggttcgaatccattctcccccaccatttttattaataccgattaaacggtattttttttatgtattttttcccattgtaattgctttatttattatattttcattactttcaatatcttttacgtttgttatgtttgttgcacataaatgtcccataagttttacaccttcaaaacatgatatccagccttcaatttcttttaatattatatttattgcactttcttcttcatcggcacatgaggcaagtagatatatttctttgaaattatatttcattgcaaatactgggttcattctatctaggaaattttttaactgtccacacattgtgtaataataaacaggtgttgcaaacacaattgcatcggcatttttaaatttatctaaaagtaatttagcatcgtcatttataacgcatttatgttccttttgacagtatagacatcctctgcaaaagtttatattgtaatttcttaaatatacaatttcgacaatatgtcctttttcttctgctccctttttaaaattttcagctaatatttctgaatttcccccttttctcattgtggaagaaataattaaaatattcttttttttcatacttttactcctttactttaatatgtacttgaacttcatttttatttgtaaaattgtcttcatccagattttctattactccgattttggtatattgatatgaagtgtcaaaatccttatagaatataaccagagtatctgctccgtaaagcataacatcacctttttttatttttcctacattatattcatccgtaggaagagaggatgataaattataatacttttcattttggttaaaatcctgcattgtaatatttaatggaagaatttttataagttcctttgtcgtttgattgttttctaaatttaaaacataatctttaccgtcgatatttatgcttaatgactgaatattttcggtatttgatgtgttttttgctatatctgttgttccactcattatcttgttttcttttttgtcagaagatttatcatttttataatttataaaaattaaacatataaatataagtaaaataataaatataaagatgaatttcttcatgattacctcctttttattttactttactatatggacttaactccaagtcaagagaaaataaaaaaacacttcatttaagaagtgtttttttatattaatacattccgatactaaataagtaagcaattactacggctattggacctgttacaagtctggagaaaagcatagccggtacgcctgctttaactgtttcatcttctgcttctgccattgttaaagcaaccggaacgaagtcgcaaccaacttgagaatttattgcaaaaagtgcaggtaatgaataagaaataggtattgttccttttccgatttcaaccccaagaagtacaccgacaacttgagcgattacggctccaggaccaagaataggagataagaatggtagggcacatattactgataagataagtaatcccggtaaagttcctgccaaaggttttattgcatttgctataatatcaccaagacctgagaataggattataccaacaagtacacttacaaatgccatgaaaggtagaatattttttattatgatatctattgaatctctacctgcttgatagaatacattaacgaatttacctattactttacctacagatgctattatatttaagaatttatttccttcatcagcattttcagcttctattgtttcatttacagctgttgtttcgctttcttcgcttttttcaaattcaatttctttatcatcttccataagagataggttgtcttcttttacgcctgatacaaaattgttttcattcatataacttgctaaaggccctgatggtgaaattggatgaatatctattgtaggtacacccattttgggataaacaccacatcttaaagtaccgccacagtcaacaactgctataatgattgtttcaggttctactttattgttgaatccgtctactgctggaacatctaaaagttcggctatttttgctgctagaggatgaattcctccccctgttattgatgcaacaactttttttgtatctgtttcatatactgttagaggaccgccccaaccgccttttccttttgtaaccgttaattttttcatcttattgtgcctttcctttcttaagtagttttactgtgataaattctgttaagttccctctgataaaagcaacgataaaagcaacgaggattgctctaactgctaaaggtgtgattgatgcaccaagggtagttatgccggctgctatacctgaccatacgaacaattctcctgggtttgcatgtgggaaaagtccaagcataggatgtgcaaatgtaaacataccgtctatacaagctgctttgtctttttcttcaacgaaacgagccattgtataacacataggatttgttaaaaagaataaagccataaaaggtaataaagtatatcttaatattctgtatttggttattttctttgcaaagttcataaccctttcttcacctattaatgcgataatggcattaattaatgttaataaaatgattaagttgggaagtatgcttgttattaatccaactaaattttctccccctttacttatcatgccgttaaaaccttctgcaatttttactactagttccatgtttttacctccgttttattattgttctaagcattccagttttttgttttgtaataattcttttgcattttccaaagctaatttcaattttttgttagatactttttcatgtagagagtcaatagaaagatttgtatagtcttctttgttttttagtcttgaaaaaaccgtatagccactcatttctaaaaattcgataatattatcattattatcaataacggtaactatcaaaaatccttttccaaatgacagttttcttttgcttgtacctgtaaccaaataatattcatctttatacttactctttagctgtgctatttttgtataaatatttttaagctgcaagtaagaaaatatggtttggacaaatataacaagaagaaacagtaccataaccataacccacattttttataccgcctttcctttattcttgatttgatattaattttggggagaaaaaatgtcaatgcgatatgcataagtggaacatattccacaaaattgacgagatatatatttgttcaaggaacatatgtgtaacatttgttctttatgggaacaaataattgacttgtgttacttgtaacattattatgtttacaagatttagctttaatgataagcagaaagaaggtatataatgaaaacaaaggcaataaggctatatggagaaaatgatttaagacttgaagagtatgaactaccaaaaatgaaagatgatgaaatattagcaaagattattacagatagcgtatgtatgtctacttataaattatcaaaacaaggagaaaaacataaaagaactcctgataatttaaaagaaaatcctgcagtaataggtcatgagttatccggtataataatagaagtaggagataagtggaaagataaatataaaaaaggtcaaaagtttacagtacaacctgcagttagtgtagatggaaaagtaaaaacagtagggtattattatcagtattacggcggagatagtacatatagtattattccaaatgaagtaatggaaaatgattgtttaattccttttaacggagattctttctttgaagcttctttatcagaacctgtttcttgtataattgccggatataacagaatatatcatacaaatgatgaaaatcatattcactcaatgggcgttaagaaaaatggaaagatagcaattttaggtgcttgcggccctatgggactagaatgtatagattatgcacttcagcttgaggatgcaccaagtcttgttgttgcagttgatgtatcagaagacagactaaaaagagcagaaaaacttttatctaaaaaagctcaaaaagatacaaaaatagtatttgtaaattcaaatgcatatgaagattctacaagtaaattgatggaactaagtgataatgaaggttatgacgacgtatttgtatatgcacctattactccgttaatagaacaagctgatagtatacttggtaaagatgggtgtttaaatttctttgcaggtcctattgataaaacattaagtgcaaatataaatatgtataatgttcattataactacacacatattaccggttttacaggaagcacaaaccaagatgttcttgatgctttatctttaatggaagaaggaagattaagccctactatcatggtaactcatattggtggacttgacagtgcaatttatgcaactcaaaatgttcctgatattccagggggtaaaaagatgatatatactcaaattgatatgccacttacagcaatagatgattttgaaaaacttggcgaagataatgaattatttaaaaggttatatgaagagtgtaaaaaatatgatggatgctggaataaagatgcagaaaaagtattattagactattataatatttcacttaatgaataggagataaaatatgttagtaaacacaaaagaattattagtaaatgcacaaaaaaacaaaaaagctgtaggcgcatttaactgcccttctcttgaagcaataagagctacaataaaagcaggggaaagcttaaactgtccgattattttacagcatgctcagtcgcatgatccgataatggaaatggaagagatgttacctatatatatgtactatgcaaaaagagcaagtgttcctgttagtgttcacttagaccatggcagtacttttgaaaaatgtattatggcaataagaatgggtgtaagctctattatgtacgatgcatcagcaaaggattttgaaacaaatatagaagaaacaaaatatattactgaaattgctcatgcagcaggggtatctgtagaagcagagcttggtcatgttggaagttttgcttcatctgatgaaggcggcggtaaagatgatgaaggtatatatacaaatccggaaagcgcatatgaatttgttcaaagaacaggagtagactttcttgcaatatcttttggaactactcatggcgtatatttaacagaacctaaacttgatattgaaagagtaaaaacaataaaagaaaaaataggaattcctcttgttatgcatggaggttcaggagtaagtgaagaagattatataaaatcaatcaaaaatggtataagcaaaattaattattatacatatatgaactgtgccggtggagaggggatacatgagtatataaagaaaaatccgaataatatggcatttgataaaatgagtctttatgcaacggataaaatggaagaagacgtaaaacgagcaatgtctatatttgactgttagtctatatttataatttattttaatttatgttattataatatagcaaatatttattatgcaaagacaacaaagaaagtaggtattaaaatggtaaagacaaaagtagtaagcataggaaaagaggcatattttgaaggatatcctttacttgtaatattcggtaaagactgtcctgatgagttaaaagatatttgtatagtacatgagtatattgacaatcccaatgctgaaatgattaaagtaggcggtaaaatacttattggtggaaatgaatataccgttgaaaaaatcggcggtgatgcagcaaatgaaaatttatataatttagggcatatgactattaattttagtcccgatttagatttaatgccgggaagcatacttgtttctccttgcgtagttcccgatataaaacaaggggatatcatagaattttaatgaggataaaatatggaaaattatgatgaaaatcgtttactaatcgaaattgctcatctatattacgataaaaatctaactcaggcacaaatcgcaagaaagtataacataagccgttcttccatatcgaaaatgataacaaaagcaaggcttcttggaatagtagaggttgttattcatgatgaaggcgttcatccttacagagaacttgaaagtgagcttaaagaagcattgtttttaaaagacgtaatttgtgtaaatgttgaatataaagacttgcttattgatagattaagttctgccgcaagcaaatatctggcaagaaaaatgagtaacaataaagttatagcaatggcagggggcagaacctgttatcagatagcatcaggttttgtgtgttctcttccttttgatgatgtaacttttgttccaatatccggtggacttggagataagtacagatatatgcaggcaagtgcaatatgcgaaatgcttgcccatagaagcggcggtaattatatggagctacatgctcctcttgttgtagattctcatgaagctaagaaaatgttaataagtcaaaactttataaaagaagtttttgataaagcaaaaaatgcagatttggcagttgtgggaataggggggcaagatagatatcgtacttgggttgaaaattatatgtataaacaatataaaagtcttcaagaattagacgaagcaattgtaggggatatatcctataacatatacaataaaagaggagaaaaaatagattgcaaatggcatgatcatttaatgtcattagacttgaatgaaataaaaaagataaaagaagttgttgccgttgccggaggagttgaaaaagccgacagtatatatacagcaataaggtgtaattatattgattcccttattacagatgtaaatacggcaaaaaaacttatttcacttgcaagataaaacaccgcttaagtggtgtttttttaatgcactattataaaataaattacatatatccatcctaaaagtccatgtattatcgcccagaatatagaatgccaagttgtataacttataaccattgcaagggcacttccgaatgaaatacctgactttacggtttttttaacaatagtcgttgtgtttcctgtttccataattattcctctttttatttattctgtcactgtttcatatgtccagttcataattccgcccatatcatatacgtttttgtatcctatgtttataagtttcattgcggcttttttacttcttgcaccacttctacagtatacgattattttttgatttaagttactaacctcttttaatttttcatttcctatggtttcgtttggaattaatacagcgtttttaatatgagatgtattatattcatcttctgttcttacgtcaattatgattacatcttctttttccatcatttcttttgcttcatctacagtaattttattatagtttgatgtaggttcttcttttgtagtaagaaatttaaaacttataaataataaaagagcaataagtaatataacgatgatagttttcattgttttctccttatatattttgtatagcaaatattatcacaaattaaattctttttaaataaaaaaatataattaatggaaaaattttcgtattgaataaaatataaaaaagtaatataatttattagaacatatgtttcaaataaacgtttgataggtgatgttatgaaaagtaacagaatatatatgtgcatagatttaaaatccttctatgcatcggtggaatgcagacagcggggacttgatccaatgactacaaatttagtggttgcagatcctaagaggagtcaaaaaacaatttgtcttgcggtatctccggcaatgaaaaagctgggcgttcccggaagatgcagattatttgaaataccaagacacataaattatataatagctcctccccaaatgaaattgtatatagatgtttctgcggatatttacggaatatatttaaagtatatttcaaaggatgatatacatgtttatagtattgatgaagtttttatggatgtaagtgactatttatatatgtataaaatgaatgcaaaagagcttgcaaaagaaattatgaaagatatttatgatactaccggtataagttctgcttgtgggattggaagtaatttatatttagctaaagtagctcttgatattatggctaaaagaacagatgataacataggcgttttaaacgaaaaaatgtatagaagaatgttatgggagcataggccaataacggatttttggagagttggaagaggtattgcaaacagacttgaaaaaataggggttaaaaccatgaaagatttggctaagacagatgaaaatatgctttataaaatatttggcatagatgcggagcttttgattgatcatgcatggggaagagaaagcgttacaatgcaagatataaagaaatataaacctaaagctacatcagtaggaaacggacaagtccttggaaaagactgcgatgttaaaacaggaaaaattatagtaatggaaatggtggattctttatgtcttgaccttacaagaaaaaatcttgtttgcagctgtattactcttcatgttagatataacaaaaaatactttaaaaaatattcacatggaacaataaccatacccactttaaccaactcttcaaaaacaataagctcttatgtatcaaagttatatgatgaaattgtcttaaaagatgcgttaattcataggttttatataacatttaacaatgttaccaataatgatatttatcagtataatttgtttagtaatatagaagaaaataaaaaggaagaagttcttcaaaaaacaattataaatataaaagataaatatggaaaaaactctcttttaaaaggaatgagcttaaaagaaggtgctacggcaagggagagaaatatgcaaatcggagggcatagaagtggagagtcaaaatagaataaagatgaaaagggaagatagggcaaaacagtttatgccttttaaagcattaaaaggatatgatgaggcacttaggataaaagaaaaagttaaagtggaaaaaaaggaattttcaagagaatatgaagaagtgcttgattacaaattaagacagttaaaaagaaatgatattgttaagattatatattattttaaaggagaatatatcgaaaaaacgggaaaggtaagtaaaatagatactgtttcaagatgtttatatataacaaatgatagaattttatttgataatatatatgacatagacataataaaagagaaataaaaaaagtgcattttaatgcacttaaattttaaaggtggagctactaacgggacttgaacccgtgacctcttccttaccaaggaagtgctctacctcctgagccatagtagcactaacagttcatataatatcatgatttaatatatttgtaaatttattttaccatatttttttcaataaattctaaaatatctttgtacacttcctgtttgtttttttcgtttaaaatttcatgacgcataccaaaatataaaatatgttttatatctttatatcctgcttcctttaaaaaatccatgctgttatggaaatcatcttcctcacctataactgggtcgtcttcgcctgcaataaataaaattggcagatttttgttttttacttcatatttttcttttttaaaggcattttcgattaatttaaacaaatttctaaatccgtttaatgtaaaaacatatccgcaaagagggtccttattgtatttttgaacttctttaacatcgctgtttaaccatttgttttttatattttcttcaaatttatcgttaaatgagccaaaaacaaccatatttagtaagttgcttctatgatgttttccttttaatttttcaagataatcaactatctttattccaagacctgcggctttattttcaaaaggagctccgcataaaataagcccgtcaatttcatcatcgtatttttgtatataatttcttgtagccaaagtacccatactgtgagcaaaaataaagtatgggatgttcggatattcttctttcattttttttgttacggcatacatatcttcgactatcatttcacctgtttcatcataaaaataccccagatcctcttttgtttcaacactttcaccgtgtcctctgtggtcatttattatgcatgcaataccgttatttgcaagatattccataaaaggataatatctttctttatgttctgccataccatgagcaatttgaataactgcttttgcattttcttctggtgcttttatataacatgaaagttgaagtttctcatcagatgaattaattgaaaataattgttctttcatttttaaattacctctgtgtaaattttaaaattgaattaagccgatttatataaacattatatcacaaaagataggattaaatataatcatgtcattttatttatataaatttaataatttataaaaaaagtaaaagaagatatattcctcttttactttttgttatacatattcattgctttgtcaagatctttgtcaagggcagtatagattgcttttgacgtagtttttacaagttctcttattataggaagttcttcttcgctaaatcttccaagaacataatttacaagatcaccatgttcagggcttccaactccaaggcgaaatcttgggaagttttttgtagcgatttcttttattattgatttcattccattatgggttcctgctccgccgttttttcttattctaagttttccttttggaagttctatatcatcataaattataaatatattttcttcaggaattttaaaataatctttaaacagttttacgctttcaccgcttaaattcatgtaagttctcggttttaccaaaaatacatcttctccggcaattttacctttgccaaaatctgccttgaattttgttttgtttatttttatatcgtattcttcacttaaataatctattgtttcaaatcctatattatgtcttgtaagattatattcgtttcctatattgccaagtcccactattaagtacatttctttctccttaagtataaaatagcttatttattatatcatttatttttaaatttcaataagattttattcatttattttatcaataatcgcttttgataccatttgcaccatatttgtcattgatgttatagccattattgcaaccatgctcacatcttctatggttttttcattaggcttaagggatatattttctttctctttttcatttttgttaagtatatctttactgtaagggacatattcgttaaaaaattccatttatcctccttaattaatttatatattttatttgaaaattatggtatattaaaataaatattaaattaaagaggcaattatgaacagtttaataaaaactatactggataaatatcaagtaagaaaatcatataaagataaaagcagatttatagaattgttaactgaatattttaataataacaatattaaatatgatattgaagaatataatgatttctttaagacaagaaatattgtagtgggtgatataaatgaagcggatacagtatttaccgctcattatgatacgtgtgcaagaatgattttccctaattttattactccgaagaatctatttatatatgctatttattcaatccttttaggattttttcttgtattgcctgctttagcggtaaaatttactttaatattatttactaaaagtgagattatcgggaatataggttatattttaattattatattagatttatatttaatgatgtttggttttaaaaacaaacatactgtaaatgacaatacttcaggagttgtaactttacttaatataatggataaacttagcagtgaagaaataaataagtctgcttttgtgtttttcgataacgaagaaataggactcgtaggtgcattcaaatttaagaaaaaacataaagatattatagataataaagttattataaattttgattgtgtaagtgacggagataatatactttttgttacaaaggaattgactatgcatagtgatatttataaaaaaatgcagaatatcatagaaagagtaaagcataaatataataaagaaatacttttagaaaacagcaaaaagacgttttatccttcagaccaaatggtgtttaaaaatgctattggtgttgcggggcttaagaagaataaaatacttggatattatcttgataaaatacacacaaataaagatatagtatttaaaaaagaaaacatagatctattgactgacattatggttgagttaaaaaaataaagccttttacggctttatttttttattatatttgaatttagaatttcaatgcattcatctgcacttccctttataaagctatccttttttaaaggtattgtcattttaccttgtaaaaatacaacaataaagttatctgtttcatcaaagcctttaacgctttcaaatggaacagatctttctgttttgtcagatttcatagttattttatcgtttatggtgatgttaaatatagggtactcttctttatttaaaagtaaagccctttctttttctgctttaatattttttctcatggcaaatttacctgaaagaaaacttactatagacagtagtactgcaacaacgccaagtgaatttttaaaggcaataaaatatgctgtgcctataataagtaaaataaaagatgaaatataaagtttcttaaattcttttttacaccaaaaagccattacttcgtttattgcattttcatcatacacaaattcatttattacttctttgttcattttttttaccctctgtttttatttatgtatattatacactatactttatgtagaaataaaaaaattacctttaaaaaaggtaattttatttattttttatttctttttccattacaagataatttcttgcatttactgtatttggatgaagtaatttcccgctttttagaattgaaagaattgttctgttaaggctcattacaatggctttgtcaatattttgatatgccatttctcttacttcttcaacgccttcatatgttcttgtttcttctataacatcggcaagaaaaactattttttgaagcatagtcatgttttcttttcccgttgtatgatattctatggcacttaatacatcttcatccgttatgttaaacttgaattttgcaactattcttcctgcttttccatgtaacaatgcggtatttactctttcgatttcatctattttaaaatattgtttttttaagatatcaatcattgcatcaggatccatatttttcgcacagtcatgaagaagagccgcaagggaagccttttctgtatcatatccatagtttttagcaagttttactgcttctctttgtgttgcaagggtgtgaatatatctgtcttcttttagcattttctttaattcgtgtttgatgtttgtgtattctttcatgttactcttcctctaatcgttataatataaattattctctattatatattgtgccactttttcaggaatttttaaagagttattttttaaaatattctttcttatttcactggaagataaatctataaggttaaaattttctaaaagggttatttttgcattgtattctttatttaaaagatctgttttttctttaagctcttcttttttataaggtggtctgttggctattatgaaatttacttcttttaaaagagtttcataatctttccatttgtgtatttcaaacactaaatcagctcctcctataaaaaataagtcattgtatttatcttttaaataagataccgtatcaattgtgtaacttaccccttttttgtctatttcataagtatctatttcaaaaaaagggtattcttctattgcaagttcaaccattttaagtctttgcattgttgaaactttgcttttattttcttttattggattgatgtttgttggtataaataatactttatcaagagaaaactctttctttgccgataaagcgagctttatatgcccgttatgtatcgggttaaagcttcctcctaaaaacccgactttcattaattataatacctcatatttatttttgtcaggatttcttttataaagtataaaagtatttcctattgttgtaacaacttgactgtttgttttatctgctaaataattagctacttctcttacatcttcaagtgaattttgttggatttttccctttataagttctctggcttttaatgcgtcttttacttgagttactatattgtcgctcattccgtctttgcctatgtgaattataggctgcattttactggcttcttttcttaaataacttctttctttgctgttcattttttacttcctatttataatattcaaattcaaaaccttctatgtttactatatcgccgtctttaatacccattttttccatttcttcaaagattcctttgtttttaagaactctttggaaatacatacttgattcataatcttcaaggtttacggattttataagacgtctcatcatttttccttcaacataatatacgttatcttcaacttcaatttcgtattctttttctgcttttggtgcgtagattactttttcttcggttgtaaagaataaaggtgtttttggtgtttcaggcagtaattcaactatacagtccattattttatcaagaccgtcattcattgccgcactggaattaaataccttatatcctttgtcttcaaagtattttgtaagttcgtttattttttcttctttttcgtcaggattaattaaatctgttttattaagaactacaatttgaggtctttcctttaatttctcagagtatagggaaagttcgttgttaattatatcaaaatcttttttagggtctcttccttctattgatgatgcgtcaagaacatgaacaagaagtcttgttctttcaacgtgtcttaagaattgatgaccaagtccttgtccatcacttgctccttcgataagtcccggaatatcagcaagaacgaattcttcgctgtttttatattttactattccaagatttggtgaaagagttgtaaagtgataatttgcaattttgggagttgcatttgttaccattgaaagtattgtagattttcctacattagggaaacctattaaaccaacatcggcaattgttttaagctctaatataagctctttttcttctgcttcgtctcccggttttgcaaatttaggagattgtctggttgaagttgcaaaatgttgattacctcttcctcctctgcctccttttaaaaccgtaacttcttggtggttttctaccatatcacaaataagctgaccggtttcactgtcaaaaataactgtacctacgggaacttcaattctaatgtcgctaccgtctttaccgctcatgttgcttctgcttccgttttcacctgcttgagctgcgaactttcttttgtatctaaatgcttcaagtgtatttaaggcattattagcaacaaaaataacgtctccgccttttcctccgtctccgcctgaaggaccgccgtttggaacgtatttttctcttctgaaagctacagcaccgtctccgccttttccgcttttaacattaatttttactttatctacaaacataatttattcctctataaaaaattaaactccacaccttttagtatggagtttattaattaaattattctattgagcttttggataaacactaacttgttttcttgttttgccttttctttcgaatttaacaactccgtcagctttagcaaataatgtatcgtctccgccgattccaacgtttactccaggataaattctagttcctctttgtcttactaaaatgttacctgctaatacatattggccgtcgcctttttttgttccaagtctttttgattcactatctctaccattctttgtactacccatcccttttttgtgagcgaatagttgtaagttatctaaattaaatttaatcattttattcctccatgatatttacttttacaaactcagggttttcttcgctaagactttctacagatagtaagaatgtctttgtcaaaacatcagtttttattttcttttcttgatttgcttcatttattttaacaagagaataaccttctttaactttaacatcaatatcagcttttatatattcgcttaatccgtttattaaagctattaacaaggttgatacactgcaacaaatcaagtcataacctttttcaccgcttccggcatgtcccttaagttcaatttgttttataaaattcgatttaatattaatgtcgatattaatcattattcagctttttcttcagcttttactaaacctgtaatttcaacttttgtgtatggttgacgatgtccttgttttcttctgtagtcttttttagctttgtatttatatacaataactttttcgctttttccttgttcaaggatttttccttctactttgtagccttctactacaggagttccaacaagaatatttgaatcttcatttaccattaatacttcatcaaaagtaactttcttttgattttttctttttggaacaattttttcaacgtttataacgtcacctttttgaacacggtattgtttaccgccagttttaataattgcatacatatctttctacctccactatcctgtctcgccgtctaaggtgtgaaaatcaacttctttttacctttttcagtgcggatacatgcttatttagtatatcatagcctttttttgctgtcaacaaaataaaatatttttattataaaattaaaagaatttttttattaaacttaaaaattattttgaacaaaaattatttatgtattcatattaaaaataaagaataaatatatatgactaaggaggaagtttatgaaaaaatatgtatatattgctctttttgctgttatattaatagcttttatgtttggaatatgctgctaccttcttgttacggcttcttatgttgataattcactttatatattggaaggtaaaaccatttgtatagatgcagggcatgggggaaaagacccggggaaagtgggaaatataaaaaatgaagatgaccttaatcttgacgtaactttaaaattaaaagatattcttatgagtatgggagcaaatgttgttttaaccagagatagtgaaaacgggctttatgaagacggaagtcttgtttggagaaaaaaagatgatatgaaaataagaagagaaataataaaagaatcaaactgcgatatattaataagcatacatatgaactctcatactgataacagcagaggtgcagaagttttatacttaaaagaccatgaaaaaagtgaacttcttgcaaaaagaataaaagaacaattggataatacatcaaaatattcaaaagaaagaaatatagagcctcatgatgatttatatatattaaaaaatgataatataccaagtgtacttatagaatgtgggtttatgagtgaagtaaacgaagaaaagcttcttaatgatgaagaatatcaaaagcagctttctaattatatagctcttggagtagtaaaatatttttataacaatgattttactcataataaataaaacagttgtaaaaacaactgttttattgtgattttattataccctttaaatatgcacttagaagcatttcaagataatatatttctttatttatttcctttgctttatccgtatcttttacaagaattcttttattgttgtcatataaaaacctttgttcactttttatatctatttcattttttaccgcataatcaatattttcaaaagggtgatgggctattaaattcattccgtaagaattgtaagttaatgtaaaacctgcaatacccgttacgcttctatatgcttttgagtatcctccgtcaattaaaagaagtttcccgtctgcttttatagggctttgaccttcttttaatttaatgggaacatgaccgtttattatttttgcattttcatcattaagagaaaactctgcaagtatttctcttgcaacttctttatttgccgcttttgtaaaatatgcaagatatttttctttgtgagtttccttgtcatctataaaatacctttcaaaggttgccattttgctttttccaaaaagaggagagtttggagagcaccataaataccagaagtatgatttgtcgctttgctcgctgtttgcaatactccttaaatgaagttccattttatctaacagttcttttcctttataatattcttcacaaacttttacttctttaaatgttccgtcttcgtttaggggtatacatccgtggaaaagaagatttccgttgtaaactaggtacatgcttccttttgtaaataacgtatctacatgttcacttagtttttcacttgatataaaactttgttttaaagattttattattttttcttcttcttctgtaagttttgcagggttatttttatctattgtaggaaaatcttttgtgttaagttcatattccttttcatctattaggattgttcctttttcaaaatcacattttgaaagtaaatctctgttatccatattatattcagggtgattttttattacctggctttcgagtttaaattgaataacggctattgccttttgcattttagcaagaattatttcatctatatcgggattttcatcgcttagccttggaagaaagttttttaaatcttcttttgttgagtttttataagtttcttgagcgaatagagataacattaaaatgcctattccataaccatcccttaaggtttcgatgtttccgtatcttaaacatattcttattacgtttgctatgcaggcttcatctccgtaatttgcacccatccatactatatcatggttgccccactgaatatcaacgctgtggtgatttgttataatatccatcgccttatgtgcacctttacctctgtcatatatatctcctataatatgaagatggtcaaggtttatttttcttatggctctgcatatttttattatgaagtcatcgcttgcttttgtatctattattgtgtctaaaatattttcaaagtataatgttctcttttcgtctttattgtttacatacaaaagttcttctatgatatttacataatttttatctaaaacatttcttatttgttcttttgttgcttttgccgatacggtagaaagaatttcaataagatattttaaagtttgtttataccagattttatgggtcttgttttcttcgtgaagaagttttaattttttatgcgggtaataaataagagttgtaattgttcttatttcatcttcgctggctatacttcctatggtttctttaacttttctttttatacttcctgaacagttcctaagtacatgttcaaatgcttcgttttctccgtgtatatcggtaatgaagtgttccgttccctttggaagattaagagaagagtttagctctattattcttgctcttacatgagaagggttttgatactgtttagaaaacaaatttaggtagtcaatattatcatatatttcttttgtgttaaattttctcatttttttaccatcctttgtattataatactataatgctttggttttataaataataatgatataaagttttttttaatatgtatgagaagtaagttaaaaaagaataaaaatatttaaaaaatacaattaatttgatatgtttattatttggaaatatgatatattttaaaatgcaattttttaattatgttataataatatataatttatgcgtttaataaaacattaagagggtatttatgtttggtaggatatttaacgaaacaaaattaggtgaaagaataaaatttgatgataaaaaaggaagcatatttgttcatggcgtaagtgcgaatttaaaaaatatgcttagtttgtatacttatgaaaaagaaaacaatcctataatatatattttaaaagatgatttggcggcaaaggaagtatataaagaacttatagatattaaaggtgaagacgatattttatattatccacaaaagcctataactcatgagtttatagatgcacattcaatggagcttacaaataaaagagtaagtgtaataaaaaatgcattaatggatgagaaaaagattattgtaacatctataaatgcaatatgtgaaaagggtgtattttttactaaagaagatattattacaaaaaaagtagaagatatatgggatatagatgattttataaaaactcttgagtacttcggctatgaaagagaatatgaagtaagtgggcaaggtgtatacagcgtaaaaggcgggattgtcgatgtattcgttatgggggaagaaaaacctgtaagaatagagttttttgatgatgaaatagattcaataagaacatttgatactgtaacaggtaaaagtattgatatgcttgaaagttttactttagttcccgcaaaaacaagtattttaaattttgagaaattaaaggaacttaataaaaaagcaagaggaaaattagaaaaagatatcgcaaagaatacggacgaagaaatagacaaaaattacagagaactttatgaaaaaataaaagataatacaaattttacaaccaagtatgttttctatgccttaaaagaattaaagtctgttttagatttatttacagatcctataattatttttgatgattatagtctactaaagaaaagctacaattctttttacaaaaaaaacaaagaagaattaaaagacctttatgaacatggaaaaattcttaataatcaggtaaacaatcattttactttttcacatgtagaggaaatatttataaggaataattccatgatttattttgatttgtctatgacatcaaataatcttttctgcaaagatataatagaaataaaatctgcagacaatatcaattatgtaaaaaacattcattttttaatagacagtatagtttcttttctaaaagatgattacaaagttttaatgacatatagaaatgaaaaagagaaaaagaacttaagcgagtttttggataattacaaattaacttacagcgaaaatattgcaaaaggaagaattgcttttgtaaaggaaaatataaagtacggtgtaaatatattaagtgaaaaaatgtttattctttcttataatgatattttaaagaagaaagaaacaaaaaaaacagtaaaaaaatctgataaaaagaaagagaaagcatttttcagcgagatatcaaaaggggactatgtagttcatgaaacatatggtataggtagatatcttggtatggtaaacatggaagccggaggattatataacgactatttggagatagagtttgcgggaagtgacaaactttatgtaattgcaaataagatgcatcttgtaagtaaatatataggaagtgacgatgcacctccaaagcttaacaagttaggttctcaggtttgggaaaatacaaaagccagaacaaaaaaggctgtaaaagagcttgccaaagaatatataaccctttatgcaaaaagaagagaaataaaaggatatgctttctcttccgatactccttggcaaaaagaatttgaagatagttttggatatgagcttactgaggatcaggaaagatgtgtaagggaagtaaaggaagacatggaaaaaccttatcctatggacaggcttgtatgtggggatgtaggttttgggaaaacagaagttgccatgcgagctgtatttaaagcctgtatggattcaaaacaatgtgcagttttggtaccaacgacaattcttgctatgcagcattacgatactttcgttgaaaggtttaaagattttcccgtaagtatagaaatgctatccagattcaagacgaaaaaagagcaagataagataatagataaattaaaaagaggaaaagtggatattgtaataggaacgcataaactgctttccgatagtattcagtttaaagatttaggacttcttgttgtagacgaagaacagaggtttggagttgcgcataaggataagcttaaacttttaaaagaaaatgtagatactcttactttatcggcaacacctattccaaggactttaaatatgtctttaataggtataagggatttatccacaatagaaaaacctccaaaagaaagagaagaaacagaaacatatgtacttgagtatgatgattatataatcaaggaagctataaacagagaacttagaagagatgggcaagtattctttgtttataattcagtaaagaatgctgaaagtacttgttcttatttaaggaaattaattccagggttaaaagttgaatttgcaaatgggcagatgcctgaaagagagcttgaaaaaacaatgtttagctttttaaataaggaatttgatgtgcttgtatgtacggcgatagttgaaaatgggcttaacatattaaatgcaaataccatgataataaaagacggtaataatcttggactttctcagttataccagcttagaggaagagttggaagaagcaataaaaatgcttattgctatataacctatgaaaaaaacagagctttaaacgaaactgccgtaaaaagacttaaagcaataaatgaatttacaaaatttggttcgggatttcaaattgccataagagatttgcagataagaggtgcaggtaatcttttaggagcaaatcaaagcggacatttttcttcggttggatatgagctttatacaaaaatgctttcagaggctttaaaagaaagcaaaggagaaaagctaaaaaaagaagtggaaacaagtataaatatgaaagtagatgcttatataggaaagaattatattgaagatgaaatgcaaagaatccttacttataaagaaatagcgggtgttgaaacagaatctgacaaagaagaccttatagatcatttaatagatgtatatggagatattccgtctgcaacaatgaacctaattaatatatcccttcttagaaataaggcatctatgaaagatgtattaagcattaacgtaaatgaacaaaatagagaaatatattttgattttgataaagacattgaaattaatatagatgtaataaataacctatatgaaatgtttaagggtaaatttataaaaaatgcaaaattcattagaatatgtttcccttataaaaagaccagaaatgttcatgtaaatatcatgaagcttatagataaaataattgataatctatgatggattgtgtataatttataagattaatcattattaatataaaagtttatgtaacagaaaggaaatgttatgaaaattattataaataaagttgttggtattgttgtatcgctgctttttgtattatctgtatgcggatgtacagtaaatgaagaaaaacttgcttcaagtgctgttgcaaaagttaatgatacagaaattttaaaatcacaaatggatgaaattgttaattttacagctgtatattattatgctacaacaggacaagatataactgaagatgaagactcttttaaaactatgaaagaagatattgttaatgatatggttgaaagagaacttcttaaaacagtagctgataaatacgattataaagttaatgaaaaagaagttgaagaaggcgtaaataatttacttgccggaattgaagaaagtcaatatatgacaaatgatgattatttggaaattttacaaaaatatggttttaaagatgaaaaaagttttaaagaagccgcaaaaacatattcagaagcaatgacttatactaatggtttcatggataaattcagaaatgaagttcaaggtaaaggctatgcaacttcaacatatatgactgttgatgatatagaagttccagcatatgtttattattatatatatattcaaaaaacaatagaagaagaatataacagctatatgaattcttattattcaagcggggattcttcaactacggaatcgaaaactcctgaagaaataaaagaagacacagaagaaacaataaaagaaaaagctgctttttatgccgaaggaacagcaaagaaacttgaagttacagaagaaacaattaataatataaaagaacaaaattcaacatatgattcaatgtatggttcagaaacaatggaatctgtatataatgcatatggaataactaaaaaacaatatgatgaagctgctacatgggtagcaactgccgatgcatataaagataaacttcatgatgaagtttcatatgaaaaacctacagaagatgatgcaaagaaagaatttgaaaaaaatacaaaacaatatgatacttcaacagtaagcgcaaaacatattttgacacaagataaagatttggcaaaagaaatttatgaacaagcaaaaaaagaaggggcaaattttgatgatttaatgagcaaatatcaaaatgatgaaagtgttgaacaggcatctgatcttggcgcttttaagtattcagatatggttgaagagttttctgaagctgtatttgatgctgaaaaaggtgaagttataggacctgttaaaacagaatatggttatcatgtagtttatgtttatgataaaaatatcgtagaacctaagtttgaagattctatggatcaaattttagttgcacttgatgccgacagaaaggcagaagctgcttctaagttagatgaagaaattaaaaaagaacataaatatgatattttaagaacagaaatagatgagccatttaatatgtttatggctgatttaaaagaaaacaataagattaaaacttataaatctataattaaaaaataaaaagaactgctttgtcagttctttttttataaaagtattgacttagagttaactccaaggtgtaaattatatatagaaaataaaaatagctataaattatatatttaaaatatagaggtaagaaaaatgaaaatagccgaagttagtaaaaaaatgaatttatctcaagatacacttagatattatgagcgtattggacttattccgccggtaaaaagaaattcttcagggataagagattatactgaaaaagatattggatgggtagaatttattaaatgtatgagaggagcagggctttcaattgaaagtttaatagagtatgtaaaattatttgaagaaggtgacaaaactgcgagagcaagaaaagatatattatttgaagaaagagaaaagttaattgaaagaattaattcaatgcaggaaactcttgaaagattaaataaaaaaattgaaagatatgaaaaatgtcttaaaaaagaaaaggaactcagaggtgaataaaaatgaaagatgacagaataggtttagcaaaagaaaatttgaaaaaacttgttaaaaatgaaaatattgaagatttgttagattcagaatttgaacaaataatgaattattttatttatggagaggtatttgaaaacagtgatttaatagataaaaaatttagggagcttattacaataagcgttttaaccgcaagcggtttattttcatctcttaaagaacatattgaatatgcattaaatttaaatataagcagtgtagaaataaacgaaacaatattacagtgttctccttatattggttttgccaaagttaaggaagctataaaggtaatgaaagaagtttttaaagaaaacaatattgagtattctgtaaaaagccaaagtacaacaagtgaagataatagatttgaaaaagggttggaagttcaaaaagaaatttttggagaagttattgataaattacacgaaaatgcaccaaaaaaccaaaagcatatacaaaattatctatctgcaatgtgctttggagacttttatacaagaaaatgtcttgatttgaaacaaagagaaataattactttaagttgtttaatatctcttggagggtgtgaaagtcaagttaaatctcatattcaaggaaatattaatgtaggaaatacaaaagaaatacttattgcggttataacccagtgtctgccatatataggctttccaagaacgttaaatgcctttaattgtttaaatgaagtcatacctgattagtaaaaaacacttaaactttatatagagtttaagtgtttttttatatataaaaaatttacagctttacttttattttacattccttttacttaagtatgatttccaaagtttaaatattggtatatcatagcaccatattaaataaagagaggaaatgaagaatatgaaaaagaaattattagctgtaggtttagcagcattatgcttaatgggatttgccggatgcggttcaagctctgaaggaactggatcaataacaatggcaggttctacatcaatggaaagcgtagcaaaagcatggggtgaagattaccttgctaaaaacggagtaacaatctcagttcaaggcggaggttcatcagcaggtgtaacaagtgttgttgatggaagcgctcaagttggtatgttaagtagagatgttaaagatgaagaaaaatcagatgatttacaaattactcaagtagcaatcgatggtattgcaatcgtagtaaatcctgaaaatggtgttgaagatttaacatctgctcaaattgctgatatttacacaggaaaaatcacaaactggaaagaagttggcggagctgacgaagaaatcgtagttgttggcagagaagctggtagtggtacaagagatggttttgaaagcattcttggtgttgaagaaaaatgtaaatacaaagctgaacttaacgaaacaggtcaagttaaatcaacagttgcttcaacaaaaggcgctatcggatatatgtctttaggatatgttgatgatgaagttaaagctgtaaaagttgacggtgttgctccaacagaagcaacagtatcagacggaagctacaaggttcaaagaccattcatcgtagtaacaaaaacagatgcttctgaagaagtaaaagcatatgttgaatatatgttaagtgaagaaggtcaagctatcgttgaaagcagccactttgtaaaagtaaaataataaattacataaattaaataattaaaacattaatgcaccatatggtgcattaatgtttattgaagaggaaaataaatgaaactaaaaaatacatataaacaagataaaatatcaagtatatttgaaaaaatattttttgtttgcgcagtagtttctattattagtgtagttgtgataagtttatacatgattatttcaggattccctgcaataaaagatgtagggctttttcatttcttgtttgggacagaatggaatccaacaggaagtaacccaagctttggtattttaccgatgatactttcaagtatatgtgctactcttggtgcaataataataggagttcccgtgggagtattaacagcagtattcttaagtgaagtagcaaacaaaaaagttgctaatattataagaccatttattgaaattcttgctggtataccttctgtaatttacgggtttgtaggattaatattggttgtaccttttattgctaatgtatttaatttatcatacggagcatgtttgtttacaggtatgcttgtacttgcgataatgatacttcctacaatcgtaacaataagtgaagatagtttaagagctcttccaaatgaatataaagaagcttctttaggtcttggcgcaacaaaaatgcaaacaatttttaaaatattaattcctgctgcaagaagcggtattacaacaggggttgttctaggtattggcagagcgatcggggaaacaatggcagttattatggtaacgggaaacagcgttaacttaccaaaattattcggttcagttagactgatgacaagcggtatcgtatctgaaatgtcatatgccgttggaactcatagagatgcattatttgcaataggtcttgtattgttcattttcattatgataataaactttgttttaaatatgattttaaataaagcagataaaaaatacgattaaggacaggagggtaatatgaaaaataaaaagttaagaattagtgatactatactaagactcttagttattttatgtgcgggatttacagcattacttgccttgtctttagttctatatgttttatttaaaggcgtaggcagcataaactgggaaatgcttacaacatctccgagcgaacttaaaggaacagttggggttcttccaatgattgtaaatactctttatatgatagtacttacacttatcgtatctgttccaataggaatcggaagtgcaatataccttaatgaatatgcaaagaaagacagcaaaatcgtaagacttgttgaattcacaacacaaactcttgcgggtataccttcaattatttacggtttgtttggatatatgttcttttctatattctgtggttttggtgtttcaattttatcaggagctttaactcttgcgattatggttcttcctactttaataagaactacacaagaagctttaagcagtgtgcctgatatgtacagagaaggtgctcttggtatgggagcaagaaaaattcatttaataagaactattttacttccatgttcaatgcctggtatcgtaacagctgtaattttaagtataggtaaagtcgtaggagaaagtgcagctttgatatttacatcaggtatgggatatatgttaacagacggagtaataagtcatatatttaaaagcggtgcaacacttaccgttcaactttatttatatgcatcacgtggagaaaacttatcagtatgttttgcccttgcaagtatacttatagttattgttttaataataaatgtatcagcgagattgctttcaaagaaattggaggctaagtaggaggaaaaatggaaaagagaaaaaagattattactaaagatatgaatctttattattcagaaaaccatgctttaaaaaatataaacatggatattttagaaaatgaagtagtatcattaataggtccaagtggatgcggtaagtctacatatttaaaaagtttaaatagaatgaatgatttggtagatggagtaaaaattaccggggaaatattaattgataatgaaaatatatatgataatgatattgatgtaacattgcttagaaaaaaagtaggtatggtattccaaaaaccaaacccattcccaatgagcatatatgataacattgcttatggtccgagagttcacggaataaaaaataaaagcgaacttgatgaaattgtagaaagaagtttaagaggtgctgctttatttgatgaagtaaaagacagacttaaaaaatctgcttttggtttatcaggtggtcaacaacaaagactttgtattgccagagcattggcagttgaacctgaaattcttcttatggatgaaccgacttcagctttagaccctatttctacaatgaagatagaggaattggtatttgaccttaaaaagaaatatactgttgtaattgtaactcataatatgcaacaggctgcaagaatttctgataaaacagcatttttcttgcttggagaattaattgaatacaataaaacttcttctttgtttgctaatccaaagcatccaaaaacagaagaatacataacaggaagatttggttgatacttaactataacttatcaaacaggaaggagaaatatataaatgagtgcaagaagaagatttgatgaagaacttggtttattacataatgagcttattgaaatgggttctatgattgaaaaggcaataaagtcttcatttgaagcaattgaaagtgatgatgaagatattgcaagagatattattgaaaatgataaagcaataaatgaaatggaaagaaaaatcgaagcaagatgccttaaattaattttaagacaacagcccgttgcttccgatttaagacttatatcaacggctatgaagatgattaccgatatggaaagaataggtgaccatgctgctgatatagcatcaatctgcatacctgacgaaagagaaaaaaatcaagaaaaatttaaaattgtagatgaaaagattatacaaatgtcaaacatagatttggaaatggttgcttcgagcatttctgcttttgtcaacgacaatttggaacttgcaaaaactaccattaaaacggatgccgaagttgacgagttgttttatgaagtcagagatgatataataaaagggcttaaaaatgatgaaatctctccgggacttgcaatggatacgttaatgcttattaagtatcttgaaagaataggagaccatgcgacaaatatttgtgaatgggtaatcttctatttgacgggagaacataaaaacaaaaaattattgtaataaaggatagtgaaaattatgggaaattatatttatgtagttgaggatgataacaatataagcgaattattgaaatgttcattggaagcatttaatttttacgtaaaagtatacgaaaattgtgaagacatgatggttgcattaaaagaggaaaaacctaaattaatgcttcttgatattatgcttccaggaatgagcggcatagatgcattaaaactacttaaaaacagtaaaaaatataaagaaattcccataattattctaagtgcaaaaagcagtgaaatagacaaagtaaatgctttagagcttggtgccgacgattatgttactaaacctttctctgttttagagctttcttcaagaattaaaagcgtgcttagaagaagttataaagaggaaaataatatattgagttataaagacataaccatagataaagaaaattatttggttacacattccggagaagaagtggttcttacgaagaaagaatataaaatacttctttatatgtttgaaaacgaaggaagggtagtaaccagagaagaacttttgaacgaagtatggggatatgattttgaaggtgaaagtcgtactcttgatatgcatatgaaaactttaagaaataaaatcggaagcgaagacgataagtataagtatataaaaaccgttagaggaataggttataaattaggataatgagaaaattcgtatttgtaagaagttttcttgtaggtcttatttgtactttaatacttagtttgtccttctttttcgtattatccaaaaatcaagataatggctatcatactacaatagaatctttccttcataccgttaaagaaacctacgaatttagtactgattatgaaaaagacgcagaatatttagaagcaatttcaaccgataattacagagtaacaattatttctcctaatggaactgttttggctgattcaacacacaaagaacttaccgaaaatcataaaaatagagaagaagttaaacaggcacttaaagaaggagaaggttattccataagaagttcttcaactcttgataaaaaagttatgtatggggctattgtgttaaagaatggtaacattttgagagtcatggtttctatgggtacaatttacagtaatttggctacaaaaattattatatttattttagctatagtaatttcttttattatatcttgggttgcagcgaggaagtttgcgaacgactccataaaaccttttggaagtgccgttgatatatataaaaaagaattttttgcaaatgcctctcatgagcttaaaactcccattacttcaataagaggatttgcagagcttatttcttccgggcttataaatgataaagataagataattgaatacagcacgacaataaaaagagaagccataaggatggatacaatggtagaagaaatacttaagttatccagccttgaagatatagatgaaaatgaaatgcctcttgaaaaattaaatgttgcagaaattataaaagaagcagttgaagttcttgattataagttatacgaaaagaaaatcataacaaatgtagatgtgcatgatgtatatatcgaaagtgtgcatgaagatatattaagagtttttacaaatcttattgaaaacggcattaagtataataaagataacggaaagatatatatttctttacgtaaagtaaaaaataaagctgttattactattaaagataccggaataggaataaaagaagaagatcttcctcacatttttgaaagattttatcgtgttgataaaagcagaaatagaaaggttgaagggacgggtcttgggctttctatagttaaaagaatagttatgaaatacaaaggtgaaataagtgttaaatctacctataacgttggtacggaatttattataaaatttgatgcagtaacaaaatagacaaagcaaaatgctttgtctattttttaattttttgagtttttttataaaaatcacataagtcttttaacatacattcactacattttggatttcttgcactacatacttttcttccgtgccatataatccagtgatgtgcatcagaccaatattctttagggattttcttcattaaagattgttcagtctttaatacatcgtcgctttttgcaagacctaatctattagataccctttgaacgtgagtatcaacagctattgcaggaattccaaaagcattagacattacaacatttgctgtttttctgcctacaccgtttaattttataagttcttccattgtgcttggaacttcttcattgtatttatcgcaaagagtaaagcaagttttcattatgttttttgcttttgtgtttgaaagaccacaactttttatgtattcatgaagtttctcttcgccaagctctaaaatttctcccggagtgtttgcggctttaaataattcttttgtaactatattaactctttcatctgtgcactgagcagagagaattgttgcgattaaaagttcaaaaggagaattaaaattaagcccgcatttatattctccgtattctttacttaatatatctattatttctaatgtttctttttttgttttcataaaaattaccttaacttttattaccttttttaattttttatttattgtatcatagagtaaaaaaattggaacaataaatatgaaataaataagaaaggaaaataaaaatgagaagaaatacaatgacaatgcttacgagcttaactaccggtatgatagcggggatagggcttgcttcttatgtttcatctaacaaagaacttaaaaagcccgtaaggaaaatgaaaaatgcagttgaaaaggctgcaaaagaggcagtaaacgaaatacaggatatgacaatgaaaaactaatgataaaagagttttaatatttatattaaaactcttttaaatattatataagttaattaaagattttgtgtattccattaaatcaattgtatatttttcaaattgtaattcatctatgttattatttatttttaaattaaaaaatgaattaagaatatttttatcttcattttctattttttccattaaatcaatatttttatgtatgtatttattggtttttaaataatatttagcttttatgcaaaaagacattgatttataaagtgaaagtaaaatgtcactgcttttttcatataaaaaattatgaactgtcatgtgataggtattacaagcatttagtaacactgcacgttttatatcttcattttttataagaggttttaaaaattctaaacttttgtatattggaagtgtatcaaaataaaactgaaaaaggtctgatttttcccagttttttatttcttcaattcctgagataaaaccgcaaaataaattattatgttctaatgaagatattatttctttataagtttttaaatcatttattgataatttatctaaaatcacaacaatgtcaatatcactgttttcatttgcttcttttcttgctctgcttccttgaagtcccaaaaatataagtctatttttaaattcttctataagtttattttttaatgtttttaaaactacatttacatcaatcattcttaacctccttatatcagtgttatattattatattataaaataattataataaataaaaaaatgtttactttttatagtcatagtgctattatttatgcggatggtattcttttgaaactataccgagaaaaatattaatagtcttcaatctacctaattgctataaagcttttatcgaaagaaagagacttttgactatcaaaaggaagaaaagaagaatgaaaatcggatttattggtgccggcaaagtaggcgtaagtcttggaaaatattttgctatgcacgaaaaaaaagtaatggggtattatagtaatactccctcttctgcagttgatgctgcaaattttacaaatactaattattttaattctttggaagatattatatctttctgtgatattttatttttgactgttcctgattcaaagataaaagaagtatgggaacaaatatgtaaatttgatatagaaaataaaatattttctcattgtagcggagctatgtcttctgctgtctttcaaaagtgtgaccaagacattcttggtttttccattcatccaatgtatgctttcagcgataagtatacttcttacaaagatctttcaaaggcttactttacaattgaaggaaacgaaaagagaattaatgttattaaggatttttttgaaagccttggaaatcatgtaaaaatcattccaaaagacaataaaaccaaatatcatttatcttgcgtttttgcgagtaatttagttgtagctttgttttataagagtataaaaattcttatggaaacagggtttacttttgatgaagctaaaaatgcactacttcctctttttatgaataatgcagagaatattgcttcaaaaggtgtaataaatgcattaagcggtccaattgaaaggaacgatgtaaaaacagtaaaagagcatttatctgttataaacggaagtgaaaaggatatttataaattgttgtccaaggagcttattgatgttgcaatgaaaaaagataatacaaaagattattgcaatatgaaaaaaattattaaagaggaataagaggatgaaaaacacagtaacaacattcaaaaaacaaaaagaagaaaatagtaagatttccatgcttacggcttatgattattcaatggcaaaattaatcgatcaggcaggtattaacgggattttagtaggggattcacttggtaatgtaatccttggttatgaagatacaatacctgtcactatggaagatatgatccaccacggaagagccgttgcaagaggggcaaaagatgcattggttgttatagatatgcctttcatgtcatatcaaacaagtgtatatgatgcagttaaaaatgcaggaagacttatgaaagaagggcttggagatgccgttaaacttgaaggcggcagggaagtatgtgaacagataaaagcaataacttctgccggtatacctgtaatggcacatcttggattaacaccacaaagcattaatgcattcggtggatttaagatacaaggaagagatgaacaaagagcaaaacaaattcttgaagatgctttattggttgaagaagctggagcatttgcaattgttcttgaatgtgttccggaaaaattagcaaaacttattacagaaaaagtaaatattccaacaattggaataggtgcaggaaaatactgcgacggacaaattttggtttatcaagatatgcttggaatgttttctgactttacaccaaagtttgtaaaaaaatacgcaaacataggcgaaataatgcaggatgcatttagaacttatcataaagaaataaatgagggtaaattccctatggaagaaaatacatataaaattgatgatgaagttatagaaaaattatattaattatggagagaaatatgaaagtagtacataaaatcagtgaagtaagagaaattgtaaataaatggaaaagagaagggcttagcgttgggcttgttcctacaatgggttatcttcatgaaggacatcaaagcttaattaaaaaagccgtagaacaaaatgacagagtagttgtaagcgtatttgtaaatcctatgcaatttggtgaaaacgaagatttagcaagctacccaagagatcttgaaaaagatacaaatttatgtgaagaaacaggagcagatttaatttttaatccaacacctgaagaaatgtatcctgaaggtttttgttcgtatgttgatatgaacggacttacaaaagaactttgcggaaaaagtagacctattcattttagaggtgttatgactgttgtaagtaagctgtttaatatcgttacacctaataaagcatactttggaatgaaagatgcacaacagcttcttataataaaaagaatggtaaaagatttaagttttggtatagaaatagtaggatgtccaatagtaagagaagaagatggtcttgctaagagttcaagaaacacttatttaagtgaagaagaaagaaaagcagctttgatattatataaaacaattaatttaggtaagaaacttcttgaagaaggtgaaagagacagcgctgttttactttcaaagatgaaagaaaacataaataaagaaccacttgcaaaaattgattatgttgaagcagtcgatattgaaaaggtagaaaaagtggataaaatcgaaggtacggttcttgttgcaatggctgtatatattggcaaaacaagattaattgacaactttgtgtttgagtgttaggaggaatataaaaatatgttactgaatatgttaaaaggaaaaattcacagagcaacagttgttcaagcagagcttgattatgtaggaagtattactgttgatgaagaacttcttgaaaaagccggaatatatgaatatgaaaaggttcaaattgtagatgtaaataacggaagtagatttgaaacttacacaattgctggaaaaagaggcagtggtatgatatgcttaaatggagccgcagcaagagaagttcaagtaggggataaaattataataatggcttatgcaaacatgagtcctgaagaggtaaaagataatcctccgaaagtgctttttgttgatgaagataataaaataaaaagaataacaagatatgaaaaacacgggctcttaacggaggatatgattaatgaataaaattttagagggtaaagtagtaacccttggtataacgggcagtattgctgcttataaaatggcaaatgttgccagtatgcttataaaattaggtgctgaagttcatgtaataatgactaaaaatgcaactaattttataaatccaataacatttgaaactttaacaaatacaaaatgccttgttgatacattcgatagaaattttgaatttcatgtgtctcatgtaaatcttggtcaaaaatcagatgtaatgcttattgcacctgcaagtgcaaatattattgcaaaaatggcttatggaatagcagatgatatgttatcaactactgttttggcagctacttgcaaaaagatagtatctcctgcaatgaatacacatatgtaccataatcaaatagttcaagataacatagaaaaattaaaagaatatggttttgaaataatagagcctgcaaaaggcatgctagcgtgtagagacattggagacggtaaacttcctgatgaacagactcttgtaaattatgtattaaaagaaatagctcatgaaaaagatttacaaggtatgaatgttatggttacggcaggagctacaatggaagctatagaccctgtaagatacataacaaatcattcaagcggtaaaatgggatatgcaattgcaagaaatgcaatgttaagaggtgcaaaggtaactttagtaagtgccaatagcagtgaagaagttcctccttttgttgaattaattaaagtcaaaagcgcaaaagatatgtttgaagctgtaaaagaaaagagcagtgatatggattttatcattaaggctgctgcagtttctgattatacgcctattgatgtaagtgatgaaaaaataaagaaaaaagatggagatctttccataaaactaaaaagaacagatgatattttgatgtatcttggagaaaataaaaaacaaaatcaagttttatgtggttttgcaatggaaactcaaaacttaatagataatgcaaaagctaaattaaaaaagaaaaatgctgatattatagtggctaactgcttaaaagaagagggagcaggttttaagggtgatacaaataaagtgacattccttacaaaagacaatattgagaaaaaagagcttatgagtaaatatgaagtaagcgagattttacttgataaattaattgaaataaaaaataaaaagaccgattaatcggtcttttttaaatatgcatcaataaataaatcaatatctccgtccattactgattgaacgtttgatgtttcggctttagtcctatggtcttttaccatgctgtatgggtggaaaacatatgagcgaatttgatttccccatgcgatttgtccatagtcgccttttatttcatcaagtttttctttatgttcttccattaatattttgtatagtttaccctttaaaatcttcatcgctgtttctttgttttggaactggcttctttcgttttggcatgatactacgatttttgtaggaagatgagttattctaacagctgagtcggttttgtttacatgttgtcctcctgctcctcctgagcggtaagtatctatttttaaatcacttggattgatttcaaggtttatatcttcttttatttccggttctacatctactgatgcaaaagaagtatgtcttctgttgttgctgtcaaaaggtgagattcttacaagtcgatgtacccctttttcgctttttaaatatccgtaagcattttctcccttaataagaatcgtaacactttttattcctgcaacatcccccgataactcttcgagaatttttattttaaaatttctcttttctgcaaatcttacaaacattctatatagcatttctgcccagtcttggctttctgttcctcctgctcctgggtgaattgaaagaatggcattgtttgaatcgtattctcctgataaaagagttgttagtgcaaaattatttacatctttttttagcatgtttaattcttttaaggtattatctgcttctgtttctatgaattcttcacttaacatttccattataatgctgatatcttcttttttgttttcaagagatgtaaatgatgttatttgtgattttaaagttttaacgtcctttaaaatttgatttgcattttcgctgtcattccaaaaattttcatcattcattaagctttctttttcttttagattttgttgtaaactttcaatgttaacggagtttgataaatcatcaagttcctttgatatatcattaagtaaattttttaattcaattaattcagtcattttattacttccttttaaatattaaatttattatatattatatgacgatattaaacaatactatcgttaaaatgctttaatgcaattaaagtttgattattgtttccttttataaaaaacagctgttaataaataatttgtaacatgattacaattgtttattagttgaatatgtaaaggttacacatttaaaaagataatcatgtttgtttaaaagatgtaaatttttatgacctttttttttctttttttatgaaagtacttgtaattatattttttatcatatataatttttttagtaaaaatcaagtgttatataaaacaaggagagattacaaatgttatatttaatcgatgatgctaatatcgaaagcattaaaacaattactcaatatttcccaattacaggggtaacaacaaatccaagcattattgctgcaaacggagaaaatgtttataaaaaaattaaagaaataagagacgttattggtcctgactgtgaacttcatgctcaagttttagcttcaacttgtgatgaaatcgtacaagaagcaattagacttagagatgctgtaggcggaaaattctttgtaaaagttcctgtaacaggtgaaggtttaaaatcaatcagcgttcttaaagaacttggctttggtgtaacagctacagctatctttacagctcaacaagctttacttgctgctacagcaggtgctgactatgtagctccatatgtaaacagaatagataatttctcttctgacggtatcggagttgttgctgacatcgttgaattattcgatatgtacggaaaagatacaaaagtattagctgcaagcttcaaaaatacacaacaagttcacaatgtagctatggctggttctcatgctgcaacaatcagctgtgatttatttgaaaaattaatctatcatccacttacaacagctgcaattatggaatttgaagaaaaaggtgcagaattctatacatacgaagaaaaatagtatgttaaataaaaaaatcaggcggatttttatccgccttttttatttgcaaaattataaaaaataatgtatatttaagatttcttactttagggtagaaaagtgagaaaaatattgtataatggtttaaatggaaagtggaggagaaaaatgaagagtaatttaaaagtaagtttagttagatacactcctgaacctgtaaagactgtggcaatggctgctaagctttgttattcaaaggttggggttgaagatataagtgaaaaaatgagtaatgaagatgctgaaaaatttgtaaagatgcttatgggattttctcatatgtcaccccttgaacatataagcttttcttttgcaatagaaggagtaagcagaactttaactcatcaacttgttagacatagaattgcaagttattctcaacaatcacaaagatatgttgacgaaaacgagtttgattatataatacctcctcaaatcgaaaaagacgaagaagccttaaaagtatttgaggaaagtatgagtatgattcaatcttcatacgaaaagctaagagatgttctaacaaaaaatgttacaaaacaaattatggacgaagacggacttgaagaaagcgaagctagaaaaaaagccgttaaacttgcaaatgaagatgcaagatttgttttgcctggagcttgtgaaacaaagattataactacaatgaacgcaagacaacttcttcatttctttgaagagagaacatgtgtaagagctcaatgggaaataagagaacttgcgacacagatgttaaaacttgttaaagaagtttgtcctgttatttttgaaagtgcaggtcctggatgtgtaaaaggcggctgtccggaaggaaagatgacttgcggaaaagcaaaagaaataagagaaaaatttaaaaatttatagaggtaagatatgagtaattatgaaagagtaagcggacgtaatgccgtaagagaaactttaaaatcaggaagaaacataaataaattatatattagcgaaaaccatgattctggacttgttaacataattaaaatggcaaaaagcaaaggtatttcaatacaaaaaacaaacagacataaacttgacagcattgcagggaatcctcatcatcaaggagttattgctctttgctctcctgttgaaacagtatctttaagagagcttacagataagcttaataaaaaagagggaaaacctcttgttgtaattcttgataatataacagaccctcataatgcaggggcaataatcagaagtgcgtactgcgcaggtgctgacggtgtaattatgcaaaacagaagaagtgcatcaataggggaaggtatgtataaatcttctgcaggtgctttagaatatatcgatatatgcgaagtgtcaaatatatcgcagacaatagatgcattaaaaaaggaaggactttttgttgtaggtcttgatatggacggagaaaattattacgatatcgattatgatatgcctcttgccatagttgtaggtgcagagggtaagggacttggaagacttgttaaagaaaaatgcgactttataagttctattccactaaaaaataattttgactcgttaaatgcttctgttgcagcgggaattgttttatttgaagcggtaaaatgcagatagaaaacagcacttttaaggtgctgtttttttataatatattgctaacttatggacttaaacaatataaaatgatagaatagtctaaatataattatgaaaggagaatagaatcaaaaatgaacgatgacgatagtgacgcggcgaacaaaccgatacctctgatagtgcgttttatatattttagatataaaaaagaatgatagaaataaatatcgaataaaaaaaacgtatttaggaggtaagattatgaaaagttcgataatattaatgattttattacaaattgttttaattgcgttaaatgctgtatttgcctgtgctgaaattgccgttatatccatgaacgataacaagcttgaaaaaatggcggcaaaaggagataaaagggcaataagactttcaaaattaaccgagcagcctgcaagatttttagcaacaattcaagttgcaattactctttccggatttttgggcagtgcttttgctgcggaaaacttttctgatgggttggttaatttagctgtgaaattaggggtgccagtttccccaagcgttttagattctatctctgtaattttgattacaattatattgtcttacgtaactcttatttttggtgagcttgttccaaaaagagttgctatgaaaaaagcagaatctttggctcttggtatgtcagggcttacatattctatttcaaagatatttgcgcctttggtaagtatgcttactgcgtcaacaaactttgttttaaggcttataggtattgatcctgaggaagaagacgaagatgtcagcgaagaagaaataagaatgatggttgatgtgggaagcgaaaaggggactattgaccatgaagaaagagaattcattcaaaatgtttttgaatttgatgatttatctgctgatgaaatattaacacatagaactgatgttattactcttgatatggaagaaagtcttgaaaagtggaaagagattatatttaatacaaagcatactctttatcctgtttgtgacggttcaatagataaaattattggagttcttgattcaaagaaatattttcgtttggaagataaaaatattgaaactataatagaaaataccatgtcaaaagcatattatgttcctgatacaataaaagcagatgatttattcagaaatatgagaaaaacaggcaatacaatggctgttgttttagatgagtacggtggaactgccgggataattacaataaatgacttggtagaacagcttgttggagaccttgaagaagataatgagattgtaaaaatagatgatgtaacatgtaaagtaaagggaattgcctctttagacgagctttcaaaacaaatgggtgtatcattatctaccgaagaatacgacacaatcggagggctaatattccatgttcttcaaagtattccggaaaaaggagaaaatattgaatttgattttgaaggaataaaagtaatggatgttaaaatatatgaccataaagtagtaagtgcggttgtaaagaaaaattcaccgaatgaagaagataaagataatgaataaattaaagactctaaaaaatttagagtctttttaaattatataatttgtcattccttcatagttaaaggaagcattaatcacttttttatatattgcattattatttatttcactggttagtgcatttttaattaaattcattatttctttttcgttaataggtgagataatcattgcattaagatattcatttttaggaattttatcccatcttacaataacatttaatttttctttaagcataaaatcaagccatattctcattgctctgccgtttccttctttaaaaggatgtgtgatattcatttctatatattttttattattttttcataagaatcaataggcatattatcaataattcttaaactttcatttaaaaattttacaggtgcaaatttaaaatttcctttagataaatctacactgcgtatttttcccgcaaaagaaaatacatccataaacagatatctatggatttgaattaattcgatggttttaccgtttatttgatttatttttaatgtgttttcataaagttgtaatgctctttgttttgaaaaaatttcttctttttctatgttcatttttacctctgttttattatatcattaaaatttatgttagaaataaatatcaaaaaaatacatttaattttgtaagaaaaaaatttttttaagataaaaaaagaaataaaaattaatataattaaaacgttattatatgttaaattaaacgcatatttcgttgactttattagtgtaattttatataataaacaaaaatacttttaacttagcacgagaggctaaaaaggttatatccgatttatgagtagcttgatggacaagctatgcattttttgcgaatacctggcctaagtgcaggtatttttttataaatatcggaggtataaaacaatgttaaaaggtcgcaatttgattgagccaacgaattttactgtagaagaattagatgaaatatttgagcttgctaatgatattcttaaagacgaaaagaagtatgttaacgtatgtcatgggaaattattggcaagccttttttatgagccgtcaacaagaacaaaattttcttttgacgcagccatgtatagattaggtggaaatgtacttggtttttcagacccaaatacatcaagtacatcaaaaggtgaatctcttgcagatacaacagttgtaatttcaaattatgttgatattatcgttgcaagacacccaagagaaggtactgcaaagcttatgagcgaacattcaagtgttccggtaattaacgcaggagacggtggacaccaacatccgacacaaacattaacagaccttcttacaattcagtactataaacatagatttaataatttaaaaatcggtgtttgtggggacttgatgtttggaagaacaattcactctttggtaaaagcaatgtcaagatatgaaaatatagagtttgtatttatttctccaaaagaacttgctatgcctgaatatattaaagaggaaatcgaaggaaaagttaaatactctgaaacaaattctcttgatgaagtaataggtgatttagacgtactttatatgtcaagagtacaaagagaaagatttgtaaacgaagaagaatatttaagacttaaagattatttcatacttacaaaagaaaaacttgaaaatgcaaaagaagatatgatagttatgcatccacttccaagagtaaacgaaatttcaacagatgttgacagtgataaaagggctgtatactttatgcaaggaagacttggaatgtatgtaagaatggctcttataatgaaattattgggggtaagtttagatgattaatgtttcaatgttaaaacaaggtattgttattgaccatataaaagtaaatcatggttatgaagtttttaaacaacttaaacttgatgaaatagatgatgttattgttcttatgagaaatattccaagtcataaaatgggaagaaaagacattattaaaatagaaacagacttaaaacttgaccttacaatacttggattaattgacccaaacattacagtaagctacattaaagacggaaaaagaataaaaaaagttcaacctaaattacctgaagttgtagaaggtattttaaaatgcaaaaacccaagatgtattactcaatatgaaaaggtagaaaatattaaattctatcttgcaaatgcagaaaaaagagaatatagatgttcatactgtgattcaaaaacaacattggttgaacataaataaggagagatatgaaaacattatttactgacggtgtactaattgatgcaaccaaaacagtaaaagaagatgttttggttgaagatggaaaaataataaaagttggaaaagatattgataaaacgaactgcgaagtaattgacttaaaaggtaaaacattacttcctgcctttatagatatgcattctcattttagagaccctggatatacctataaagaagatattgaaaccggtatgaaagcaagcgttaaaggcggatatagcgttgtttgcactatggcaaacacaaagcctgtttgtgataatacggaagttttacaatatgttaaagaaaaatcagaaaaagtaggtttaaataaagtaatccaaattagtgcaatcggaaaagaccttgaagataaagagtttgtagatataaaagaaaatatgaaatacacaaaccttttctcaaatgacggaaaaacaattttcagcgatgaatttatggaagaggctttgaaaaaatccacagaatatggtttccatttactaactcattgccagcctgaagaagaaataatcgaaagagatatgaaacttcttgaaaaggttggaggaaatcttcatgtatgccatatcagtacaaagaaatctttagagcttataaaagcagcaaaggaaaaaggattaacggtaacttgtgaggttgcaccacatcatttatttgccgacagcctttcttatagagtaaatccttcttttgcaacacctaaagacagaatggcacttatagaaggagtaaggaataacgatatagatattcttgcaatagaccatgctcctcattcaaaagaagataaagaaaaaggagctccgggaattgacaatatcgaagttgctttttctatgtactataaagtattctttgataatgatatcagcataaatagattaagcgaaatgataagtttaaatccggcaaagaaaataggtttaaacaaaggtttaattaaagaaggttacgatgcagatttggttgttgttgatactgactatgaaggcgttataaacaaagacgaatttatttcaaaatcaaacaacacaccttttaataaagaaaaaattaagggcaaagttttaatgacatttgtcgggggagaaaagaaatatgaagctgatagataaattatatgaaagaagcaagaaaaacatggctgtatgtttggggcttgatacaaaagaagcatttttacctgaatatataagcaaaatggatatatctttaggagaaaagtattttttgtttaataaagctataatagatgccacaaaagatattgtagcttgttataaagttcaaattgcttgttatgaagctcttggaatggacgggcttaacgcatatcaaaaaacacttaaatatataagagaaaatgacggcattgtaattgcagacataaaaagaggagatatttcttcaactgctgcaatgtatgcagacggtcatttcaaaggagactttgaggctgactttattactataaacacatatatgggacttgatgcaatcagcccatattttgactatatgaaagacggaaataaagggcttttcgttttagtaaaaacatctaatccaaacggacatcaaattcaagacttggaagtaaaagatggcgaaaaagtttatgaaaagatggctaaatacgttgatgagtggggaagcgactttgtaggagaatgtggatatagcagtgtcggagctgttgttggactaacttatcctaaagaatttatagaagtaaagaaatttatgccaaaagcattcttcttaattcctggatatggcgctcaaggtggaacaggaaaagatattgcggaaatcttcaaagatgatatttgcggagttgttaattcttcaagaggaattatatctgcacacaaaggtaaaatcgaagatgaaaactttaccgaacttactgtaaaagcagtaaaagatatgcaagaggatataggacaatggctatagtattatttaatgaaaaaataaaagatgatatctacatgatgaaacttgagggaaagtttgaaggaaaagaaggacagttttatatgcttcgctctttaaatacatttcttgcaaaacctataagtattcatgatatagatgaagaaggtataactttcttatatcaaataaagggagagggtacaaagtactttaagactcttcaaaaaggaatggaacttgatttatttggtccaagaggtaacgggtttgatatagaaaatatcgaaaaagacgttacattaataggcggaggtataggaactgctccgctatattatctatgtaaacaaataagaaaaaaatatcctgataaaaaaataagagtatatcttggttttactaaacaagattatcttgtagatgattttaagaaaattgcagatgaagttatagttgatgtaggcggaataataactcataaagttgattttacaaaggatgatatttactttacttgtggtcctgatattatgatgagaagtgcatatgatcttgctaacaaagcaggaagagaaatatatgtgtcccttgaaaacagaatggcatgtggtgtaggagcttgtcttggatgtaatgttgagactccaaatggaaataaaaaagtatgtaaagacggtcctgtatttgaaggaagcgaggtatactaaaatggatagattaaaagtaaatttcttaggtaaagaatttagtaatccattggttgccgcaagcggaacttttggttttggaagagaatacagcgagttttttgatgtaaaagaaattggcggtatatgttcaaaaggacttacattaaatcctcaacccggtaataccggagttagaatttgggaaactccaagcggggtaataaatagtattggacttgaaaatcccggtgttaaaagttttatagaaaacgaacttggatatatgaattctaccggcagcagggttatagtaaactttggggctcacagcaaggaagattttcttgatggaatagagcttttaaatgaacaagaacttgattttatagagcttaacatttcatgcccaaatgttaaggaaggcggaatggctttttgtatgcattcagcaagtgcttatgatattacaaagtccgtaaaggaaaaatcaaaacatcctattattgttaaattatcgccaaatgcaccaagtgttacagatgttgcaaaagcagtagaagatggaggagctgatgctgtaagcttaacaaatacatttcttgcaatggctattgatataaataaaaagaaacctgtgtttgataatgtatatgcaggtttgtcaggaagtgcaataaaacctattgctcttagaatggtacatcaagttgctaaggaaataaaaattcctatattggcttacggaggagtaagcaattataaagatgctcttgaatttgtaatggcaggagcaactttggtaggagttggaagtgcaatttttgcaaatcctatggtaatgcttgaaataagagatgatttagataaatatttaaaaaataataatataaacaatataagtgaacttataggtatagtataaaggagagtatgtaatgagtgaacaaagagtaaaagaaattttaaaagaaactgaagcatttttagaaggtcattttctactttcatcaggaagacattcaaatcaatatgtacaatgtgcaaaacttttaagatttcctgataaagcagcagaagtattaaaagatgttgctgaacaagtaaaagatttaggtattacaaaaatatgcggacctgcaatgggcggtgttatagtttcttacgaacttggaagacaacttggaatagaaagtatctttacagaaagaaaagacggtaacatggaacttagaagagggttcactgtaggaaaaggcgataaagtcttaataagtgaagatgttattacaacaggtaaaagtacacttgaaacagtaaaagttttagaagatatgggagctgaagttgttggggtatgttcaatagtaaatagaacaagtgatgatcttaatttcccacttcctatttattctgcaataagacttaacattgtttcttatgatagtgaagaatgtccactttgcaaagaaggaaaaattgaacttgtaaaaccgggcagcagagattttaaaaaaactaaataaagaggttagaagatgaaaggatacttacaacttgaaaatggaatgacttttgaaggtgaacttttcggtaagatagaagaaaaagtaataggtgaagttgtatttaacacatctatgacaggttatcaagaaatccttacagatccttcatattatggtcaaatagtaacaatgacatatcctttaatcggtaattatggggttaattttgattatgaacaatctgcttgttgtaaggcaagaggatttattgtaaaggaagtaagcaataaaccaaacaatttcaataatgaaatgactcttcccgattatttggaaagtgaagatattacagcaataagtggtgtagatacaagaatgcttacaaaagtacttagaaatgaaggtgttatgagaggtatgattacaactcatatgatgccaaaaacaaaacttattgaaatacttgacgaatttgataattcaaaaagtgtattcagcgtttcaacttctgctccttttgaagttgaaggtgataaggatggaaaacatattgttgcaatagattatggtataaaagcaaatattatcaatatgtttaaacaaagaggtgtaaatttaactgtagttccttttgatacaaaggcggaagatatattaaaaatgaatcctgatgccgtatttttatcaaacggacctggagaccctgctgatttacctgaatgtgttgaagaaattaaaaaattaataggaaaacttcctataataggaatttgtcttggacatcagttagcatctcttgctcttggaggaaagacttcaaaacttaaatttggtcacagaggtggaaaccatcctgtaaaaaatttagataatgaaaaagtatttatgacaagtcaaaaccatggttatgtagtagatgaattacctgaaggtgtagaagttacttatagaaatataaatgacggaagtatagaaggaatgagatgtaaggataagaagatatatacaattcaattccatcctgaagcttgtcctggaccttacgaaggcgttcatatttttgacgaatttttaaaggtgatagaataggaggaatgtacaaatgccaaaaagagatgatataaagaaagtattggttataggttctggtcctattattatcggtcaagctgcagaatttgactattcaggaacacaggcctgtgaagcattaaaagaagaaggtgttgaagttgtacttgtaaactctaaccctgcaacaataatgacagataaacaaactgctgataaagtatatattgaacctttgaatgtagaatctttggaaaaaattattgcgaaagaaagaccggattcaatcattggcggtatgggtggtcaaactgctcttaatatgacaatggagcttcacaataaaggtattcttgataaatacggagtaaaagtaataggtacaagtattgaaggaatcattaaaggtgaagacagagatgagttcagaaagttaatgaaagaaataggacaacctattattgaaagtagaattgtaaatactttggaagatgcgaaaaaagcagctttagaaataggttatccggttgttgtaagacctgcttatacacttggcggtacaggcggcggtatcgttaataatgaagaagagcttttaaaaattgcagaaagcggtcttgctttatcaatgactactcaggttttaattgaaaagagtattaaaaactggaaagaaattgaatacgaagtaatgagagacgcaaaaggtacttgtattacaatttgtaatatggaaaatatcgaccctgtaggtatccatacaggagacagtattgttgttgctccaagtcaaaccctttcagataaagaatatcaaatgctaagaacagcatctatagatataattaatgcagtaggtattgaaggtggatgtaacgtacaaattgcccttcatccagacagtatggaatatgcaattattgaaattaacccaagagtttctcgttcttcagctcttgcatcaaaagctgcaggttatcctattgctaaagtttcagctaaaattgctctaggatattatcttgatgaaattaaaaatgcagttacaaaagaaacttatgcatgttttgaacctgctcttgactatgttgtagtaaaaattcctaaatggccttttgataagtttttaaatgcaaaaagagatttaggtacaaaaatgatggctacaggagaagtaatggctataggtagaacttttgaagaagcattcttaaaagctatacgttctcttgaaattaaaaaacatactttagtacatgataaagtaaatgatattccaatcaaagaacttagacataaagtatttaaagcagatgatgaaaggatttttgttcttgctcaaatgcttagaatgaaatattctgtaacacaagtaagtaaaataacaggtattgatttattctttgtaaataagataaacgaaattgtaaaaagagaagaacatttaaaaactctaactttagaaactttaacaaaagatgaacttcttgatttaaagaaaaaaggtttctctgataaaggtattagtttcttaatgggcgttagagaaaaagatatatatgaaatgagacaaatgtggaatattaatcctgtatataaaatggttgatacatgtgcaggggaatttgaagcaaatactccatattattactcaacatatgacactgaagatgaagtagtagtaacagataaaaagaaagttatggttatcggttcaggtcctattagaatcggtcaaggtatagaatttgattacagttcagtacattgtgtatatgctctaaaacaacttggaatagaaacaatagttgtaaacaacaaccctgaaactgtaagtacagacttcgatatttcagataaactttattttgaaccattaacagatgaagatgttcttaatatttataataaagaaaaacctgatggagttattttacaatttggtggacaaacagctatcaagcttgcagaaatgtgtgtaagagaaaatattccaattcttggaacttctcctgacagtatcgataaagctgaagatagagaaagatttgaagaaatgcttacaaagcttggtgtaaaacaaccaacaggaaaaggtgtatttacagttgaagaaggtattgaaacagctaatagaatcgaatatcctgtacttgtaagaccttcatatgttcttggtggtagaggtatgatgatttgccatgatgaagaaagtcttgtaaaatatctaacaaatgcaattaaagaagaccctaaaaatccagttctaattgataaatatttatatggtcttgaacttgaagttgatgctgtgtgcgatggtgaagaagtttttgttcctggtatcatggaacatcttgacagagcaggggttcactcaggagatagtgtaacaatttatccaacaattcatgtaagtgataaaattaaagaaacattatatgactatacaagaaaaattgctcttgagcttgatgttagaggtatgataaatattcaatttatcgtatttagagatgagttatatgttatcgaagttaatcctcgttcaagtagaacagttccatatattacaaagattacaaatgttccaattcttgaaatggcagttagatctatgtttggaccttgcattaaagaaatgggatatggaagttatataaatgaagacagcgaatattatggaattaaagttccggtattctcaacagaaaaacttcctaatgtagaagtaagtcttggacctgaaatgcgttcaactggtgaagtacttggtgtaagcaaaaattatcttgaagcactttataaaggattccttgctgcaggatttgatttaagcagaagaaagagaaaacttcttatttctctaaatgacgaaagtaaagatgaacttatagactcactaaaaaatatgtcagatattggatatgaattctttgcaacaggaaatacaaagaaatttatggaagaacatggtgtagaaaatgttactgaagtgtataagattggttacgaaggagaacataaagaacttggtattcttgatgtaattaaaaatcataaaattgatttaataatcaatactcctcaaagctcttctgattctgaaacagacggattcaaaataagaagatgtgctgttgaatgtggagtaagcatagttacttcaatagatagtgcaatggctcttgctaaattattctgtgaagatttagactatgataaatttgatattacagatgtagcaaattattaataaaagtaaaaagacggcttgttgccgtcttttttatttgctttcatgggattctttttgtaaaagttctcttcttctctttttagaaaatcgttcttcttcgctaaaaatacatccgcagtagttttgtctgtataaaccgagttctatggctttttcctgtccttcgttaaaataaggtctaaaatctctatatagaaatttaacatcatatttttttgctgcagcttttgcaatggagcaaatcaaattatggtcttgaaaaggactaattaacaaagttgtagaaaaggcatcaaatccattttcttttgcgtatcttgctgtttcaaaaagacgcatattatagcatacaccacatctgttatcaaaattagggtaaatattatcaatgaactctctaagtccatattcattttctataataagttttatattaatgctttcagtataatcaataagtgttttttttctttttttatattcattaaaaggatgaatatttggattataccaaaaacaagttggttctatattttcttttctaagtgtatcaatgcacattattgaacatggagcgcaacacgaatgtaataatactttcaaaataaatctcctttatgtataataatatattataaaataaaattggttaattgcaacaagataaggaaataataatatggtaaatataatagctttggggattgttttaattttagttttaatatttattataattggcatttcaatgattaatacaaaagataaacctatacagtatttatcaaatacaaaaaaactaccaaatgtaaaagacataagaggatataataaggctattggtaaaatatttactatttttgctttgcttcttttacctattttatcacctgtagttttatttgttcaaaattcaaagtattcgtttttatcaattttattaatgcccttttgggtgataggacttattatttcttgtgtatttacggaagggaaatataaaaaataaattagatattataatatattttatgtctattaatgttataaaaaaagaaacatctaatatttagatgtttctttttattttaaatattattttttagcttcttttcttgcatttgcttcttcgattattttagcgcttgccatttgaggaacttcatcatatctttcaaattccattgtgaaagatcctcttgcttgagtcattgaacgaagttctgtagcatatttgaacatttctcctaaaggaacttcagcagtaatcattgttttaccgtttcctacaggatccattccaagaactctgcctctcttcttgtttaagtctcccattacatctcctgtgttatcatcaggaattgtaatttcaactttataaataggttcaagaagtacaggatcagcagctgccataccttgcttataagctatgcttgcagccattttaaagctcatttcgtctgaatctacaggatggaattttccgtcaaacaatgtagctttaagaccaacaacaggatatcctgctagaacaccatgttctatacattctcttaatcctttttctacagcaggaatgaagtttcttggaactgcaccgcctacgacagcatctacaaatactaaatcatcttcaagattatatgtaggttcaaaatcaatgtttacaacaccaaattgacctctaccacctgattgttttttatgtttaccttcagcagttgcttttttctttattgtttctctgtaaggtataataggtggagttaatacaacttctatgccaaatttatttttaagtttttctttaacaacttcaagatgtgtttctcccataccgtaaagtacgttttgatgtgtttcatcatctcttttaacaacaattgttgggtcttcttctcttagtttattaagacctgttgaaagtttatcttcatctcctcttgatttaggttcgatacctgtaaagataatagattgagggaagttgattgggttaaacttaatatggtctttaggatcgcataatgtatctgatgttttagtatatgcaagttttgcaagtgcaccgatatctccaggatgcatttccataacttcttcttgttttttacctattaaagtataaaccttagcaattttttcttttttgtcttgtgttgtattgttaagctccataccaggttttaaaataccacttttaactttgaataaagaaagttttccaacaaatgggtcagcaattgttttaaatacgaaagcactaagtggagcatcatcttcgtaatgtctttgtgcttcttttccatcttgatcaacttttgcagcttttgcttctattggtgttgggaagttatatacaattgcatctaagaatttatcgatagctatatcatttaaagcacttacgcaaaatactggtataagttcttcgtttgctattgctgttttaacacctgaatgtaattctgcctctgttaacgttccatcttcatcttcaaaatatttttccattaattcttcatctgttgttgcagcaatttcaaaaataatgtctttatattttgttgatttttcaattgtagagtcaggtacatccgtaattgtcattttgcctttttcgtatgtataagccttattatcaaaaatatcagctacgctgttaaaaccaactccttcgttgatagggatttggaatggaacaatcttaggtcctgtaagggctcttaattcttccataactttatgtgtatctacattttctctgtctagtttattgattacaaaggcaattggtattcctctttcaacagccatttcataagctttttctgttcctacttgaactccgcttacagcatcaactactattactgcagtatcagcaactcttagagccgagcattgttctcctatgtaatcaaaatatcccggaatatctagaacattaattttaacgccaccgtgttctatagggataagtgatgtagatatggaactatgtttactttgttcgcacgaatcataatctgaaattgttgttccatcttctgttcttccaagtctttctattagacctgctttaagagccatagcctctgcaagcaaggtcttacctgagcctccatggccaagtagtgcaatgtttcttatgtccttggttttatacgttttcatttgtctttctccttttgcttttatttttgatgataatattcaaaaaggccgcagcaatctcacgagattatttagctacaaccttatgtcaacgatattatttactttttcttttttttctttttttcatgtggaaaaaatccttaacaaccattacagcaaacattacgttttttgcggtggaataatattgttttattttcatcgtactatgcattattccatttggatcatcaagcggtgttttaagtgctgtttcaattccttttacagagttatttactttgtttgtcagctcctttgcatcgcttgttattccctcaacattttcaattattgaattaattttgtttgtatttgcactggtaagtgtttgcacgtctcttagtacatcgttaagtttagtcattgtttttgatagtttgctaacggttacaattaaatataaaattaatacgaccaaaacaacgcatacaattattaaggctatatctaagggactaaggtttataatcatttaattttattctccattataaaagttcttcgtcaaattttaattcgaaatcatcaagattttcttttttagtttcttctttagcttcttgaaccatatcttttaagtcatcgatttgttcatctgcataattagcaacatcatcaattctttctttagctgtgtttaaagctaaatcagcacttgcttttgcttgtttagaaagtttttctgctttttcaagtgaatgttgcgcaaatgtgcaaagttcatcttttgcaatataataattatcaatggcaatatccattaattcttctttattgtcgtaagcatattttgcagctatacctgcagctattccaactattaatcctgctaaaaattttccgtttgacataatctccatcctccttaatacatctaataatatattatcacattttatacaaaaaatacatagaaatttaactctaaattttttatgataaatttttaccttttgaatttatattttttagcttgtttattaatatacttaacacaaaagcaataagcgttggcactatccatgcaaaacctatatcataaaaaggtaaatttttgcttaatcctgaaaataaaggtatgtttattaaaatacttattattaaacatactgatattgtaagtggatatacaatattattgttacttattttcttatttatacatgcaagtataattaatacaattgatacagggtataaaatattaagtacgggaaccgaatattttaaaattggtgtaagacctattattgagattaagaaagaaacaagagcaaaaattataacccagcttctatagctaagtttcggaaatgtttcattaaaataagttccgcagcagctaaaaagtcctatgcaagtatttaaacatgctataacaaatatcattgcaagaattattaatcctactttaccgtaaatcaaagaaactacataagttaaagtttgggctccattttctgtcatttgtccgcttattcccgtaaaaagtcctgttattccaagcataaaatatatgattaaaagaaatattcctgctaaaaatccagctttaatcgtatattttgtaactttgttactatcttttattcctttttcgattatattcattgaaataatcatgccgaagtttaatgccgcaagggtgtccatagtttgatatccatcaataaatccctttacatatgaaaggtttttatatgtatctattggctgtactacgttaccaaataatgtaaagcaagttcccacaaaaactataaaaataagaacaagcaaacaaggggtaagtcttttacccaaatactccgttagtttttccggtttttgtgcaatgatgcctgcaattaagaaaaaaataaaggaataaattatacttggtataatactgtttacattaaaaaatggtaaaactgccatttcaaatgaagtacttgaggttcttggaattgcaaggcaaggtcctattgcaaggtatagaactagaataaaaacaaaagaaaaaacaggatgaaccctatttgttaattgttttaatcctcctgattttgtgactgcgtataccgccagtacaggaagccctattgcacttaaggaaaacccaataaaagcaggtaaaaaatttgtccctgcgtttgttccaaggtatggcggaaatattaaatttcctgctccgaagaacattgaaaataatgtaagtccgattagtaatgtgtctttcttatttaatttgttcatgatatgtccctcttaaaaaatgtttgagttattttaccataaaattacttttttgtaaaaataaaaaaagcataccaaaaggtatgcttttaatttttaattattattcagctgtatatggtaataaagcagcatttcttgcaatattaacagcttgagtaacgcctctttgatgttttgcacaagttcctgttactcttctaggtaaaattttgtatctttcagatacgtatttctttaatacttttgtatctttataatcaatgtgttcaattttgttttcacagaagtagcaaactttttttcttcttctgaaaccgccattagaaccaccttgtctttgcatagccatagcttttctccttttttaatatttaattaaaatggcatatcgtcatcatccatttcactgaatccatccataggaacaccgaattcattgtcaggggatgagaagttattgttatttctgctcatgccgtcatttttagagcctaaaaatgtaacttcttcggcaacaacttccgtaacatatctttttgagccatcattggcgtcataacttcttgtttgaattctgcctgcaacggctgtttgtctgcctttgcttaaatattgtccgcaaagttccgcagtttttccccatgcaacgataggaatgaagtctgttcctctttctccgtctcttgatttaaatgttctatcaactgctaacgtaaatgtgctaacacttgaacctgaagataaaactcttgtttcaggatctcttgttagacgaccgattaatactactttgtttagcattttattctcctaattaatatcttttaacgataatgtctcttaagatatcttctgtaattctgaatgtgtgatttaattcatcaagacatgctttttcagcttcaaaattaattaatgtataatatgcatcacgatatttatttttaattttgtaagcaagttttctcatgccccattcttcaacttcttcaacgttaccaccgttgtttttgattacgttttgaattctttctattattcctttgatttcttcttcagtcatgtcaggtctaatagcgaaaagtgtttcatattttctcatatctttcacctccttgtggacttatggggaaaacatcatgttttcccaaggatgcgacttttcgtcacagtttactaattatagcattataaaaggattcttgtaaagttttttttgaaaaaaaaataaaaaaagagcagtattctgctccttttttgtataaattttttatttcgtataaacttttgaatctattgcatattttgttacatataatgttttttcttcataagcactgtttctttcttcaactgttggagaaaccgtatagtcgcttccgtaaatcattttatgaagatattctacatttgatttaagtgtatcaaatacaaggcaccatgctccgtttattgttgctgattttactatgttttcatcagtaagggattgtgattttggaccttcttcgcttttaaagtatgctcttaatattggccacatatcgtttgattcaagtgatgttgtaatataaggaagtactgattccatcgcctttttttgtgttaataagtcactgcttttaagcttttcatatattttattcattactattctttgtcttgcggttctttggtaatccccgtttcctgcatatcttattctgcaatatgataaagcttgttttccgtcaagaacctgttcacctgattttgtaagttcttttgaaggtgttcctccaaggagtttattgttttctcttataaatttatttaagttttctatttcatcttcttttacatccaaagtaattccgcctaaagcatcaacaatatctgcaactgcttcaaagtttacttcaacataatcagttatgtttaaatcaaagttttcatttaaagttttaacagtcattagtggtccgccataagaatgggcagcattaattttatcaaatccatagtcttgaccgtctgtttgtgcaatttgaatataagagtctcttagtattgatgtaagagagatttctcctgtttttgtgttaacggagcatatcattaaagagtctgttcttccgctttcttctcctcttgagtctacaccgaataaagcataatttttaatatatttactttgttctccataatagtcttccacataagaagaaattcctagttcttcattgcttgtagggaaatctacagtattcatcttagcaaatatttgatttacttgataatatgcaaaagcagcacctattattaaaaatactaaaatgaagattgctattttcttaagtcttcttctccattttttttgcggtttttttcttctttttcttcttttttgatcaaccgggattctgtttttaggatcgttatttctattggttgttttcctttgttttctttttggacggcttggcctttttttgttatggcttctttgttccttatctcttatttttctaagttcacccaaagcttcgttctcatcaattttaatgatttcgccgtcagctctttttactacaattttacccattataaacctcagctcattataaaatattgtaaatattctaacgtaataatattacgaaaatattatgacctaattaattttttattaagaaaaagttttctcgaatttaatattttaacaaaaaaattgttaattacaataatataataaatttttaatcataatataataaatttttttataaatatatttataatacatattgtttaaaataatttgtaaataaatatctaaaattatattttttttaagtatatcataaaaacttataatagtataatatttattgatttaaccttgataattgaggagtacttgtttaaaatactattatggaattatctaagagaatagaaaataaagtaaaacaatttatcattgataacaatttaataaagaaaaatgaaagagtaatgattgcgttgtcaggtggaagcgattctgtctgtctttttcatattttaaataaacttaaattatctttgtcttttgaactttttgcttttcatttgaatcataatattagaaaagaagctaaagatgatgaaatgtttgtcagaaaattatgtgacaattatggcgtaacattatttttaaagagtgtagatattccgagtattcaaaaggaagagaatttaggacttgaagaattaagcagaaatattcgttataatttaataaatgaggtttctaaagaaaacaaaatagataaaaccgcaaccgcacatcatttgcttgatcatagcgaaagcattattttaaatatggtaagaggaagcggtataagaggtcttagagggattggcgtaaaaaacggtaatataataagacctatgcttattttatcaaaagatgaaattctttcttatattgaggaaaataatttaaaatacgtaacggataaaacgaattttgatacagactatagcagaaataatataagacataatgttttaccacatttaaaagaaataaacaataaagcttttatgcatttctttgagctttctttggtttgtgaagaaattgaagatcttcttaatgaactcagcagtaatgtagatatttatcatgaaaaaaatttggtttatgtttatgtaaatgaatttaaaaagttaaatagagctgtaaaaaaacaggtattgtttaatatgttaaggtcaataaaggttacaaaagatataagcagtaaacatgttaataaaattatagaacttatacaaaaaaataaaactacatttgatcttaatatatcaaatgatatagttgttaagagaagatatgaaaaactttattttgaatataaaataaaagaaaataacatacaaaataaaaaaataaatattaaggttgataatttagataattttaaagcacaaataaataattacaaaattaatttaaaaaaaattaaatttttagaaaaaaatactgaagataaatacgttgattatgataaaataaaaaataaccttattataagaacaagaaaagagggagatgtgttttatccttttggattagaggggagtaagaaattaaaaaaatatttcatagataagaaaattccaagagaaaaaagggatgaaattcctcttttagttgacggagaaaatatagttgctgtaataggatacgaagtaagtgacaaatataaggcagataaaaatacaaaaaatatattaaacatacattataatattgagaggtaaaaaaatgaaagaagatatcaaaaaagttttaattacagaagaagaaattaaagcaaaggtagaagaacttggaaaagttttaacagaagattataaagacaaaaacccacttgtaatttgtgttttaagaggggctgttatgttcttaagtgatttactaagagaaatagatacttttgttgatatggactttatggctgtatcaagttatgaaggaacaagttcttcaggagttgtaaatatcgtaaaagacttaacaacaaacattgaaggaagagatattcttatagttgaagatattttagatacaggaagaactttggattacttaataagaattctaaaagaaagaaatccaaagagtataaaagtatgctctttacttattaaaaaaggaagagaagaaataaaagttcctgttgactactatggattctatattccaaatgaatttgttgtaggttatggacttgactacaacgataaatacagaaacttaaaatatatcggaattttaaaagaagagatatattcttaaaaagggttaatatctgcttaaattattgttaataatgaataagtatgataaaatataaaaattaatttaaaaggaaaggattggagcagaaaatttgaacaataaaaaatttagaaccataattatatatgttgtgcttatatttggcgtatattttcttataagcatggtcacaggttctgtaaatccgctttcaaatgcaaaagtggaaaaggcttcatacagtaagcttgttcagaatttagaggccgataacgtaaaaagtataaccataaacagaaataaacaaagtgccgaaactacattaaaaagcggtgatacaattttagtatcaaatgttgctttatctgaattagacagtctattgacagactatattaaagcaaatccgggagaaattgatgttaattatgaaatatcaaattcaacaggttggaccaatattttaatggttcttgtatctcttggattaatgggctttttaatttttgttttcttctctcaacaaggtgggggcggaagcaaagttatgtctttcggtaagagtaaagcaaaattatatacaaaaagcgataaacaatatacatttgatgatgtcgcaggcgcagatgaagaaaaagaagaacttgcagaagttgttgactttttaagatcaccaaaaaggtacattgatttgggagcgagaattccaaaaggtgtgcttcttgtaggacctcctggaacaggtaaaacattacttgcaaaagcaactgcaggggaagcaaaagttccgttctttagcataagcggttctgatttcgttgaaatgtttgtaggtgttggtgccagcagagtaagagatttatttgaaacagcaaagaaaaatgcaccatgtattgtattcatagacgaaattgatgccgttggacgtcacagaggtgccggacttggcggtggcaatgatgaaagagaacaaactcttaatcaactattggttgaaatggacggattctcaaatcaagaaggaataatcataatagcagcaacaaacagagctgatatattagaccctgctatattaagaccgggaagatttgacagacaaattcttgtagcccctcctgatgtaaaaggaagagaagatatcttaaaagttcatgcaaaaggcaaaccattagaagatgatattgatttaagcattattgcaaaaagtactgccggatttacaggtgcagaccttgaaaatgtaatgaatgaagcaagtttacttgctgcaagaaaaagagaaaagaaagtttctatgaaagacatagaagaagctataaaaagagttattgcaggacccgaaaagaaaagtaaggttattactgatgaagataaaaaaattacagctgcccatgaagctggtcatgcaattgtaatgaagagtcttcctcaatgtgatgaagtaagagaaatttcaatcattccaagaggaatggctgcagggtatacaatttcgcttcctgacaatgataattctcatatgccaaaaggtaaacttcttgatatgatttgtggtttacttggtggtagagcggcagaagaagttatgcttgatgatatttgcacaggtgcttcaaatgatattgaaagagcaagtaaaattgcaagaagcatggtaaccgaatggggtatgtcagatttacttggacctttatgcttaggcagcggacaagatgatgtatttataggaagagacttcttaagaagtaaaaactacggagaagaagttgccagtgcaatagataaagaagtaagagatattataaacgaatgtcatgaaaaagctattaatattttagctgaaaataaagataagcttgaacttatcacaaacgaattaatcaaaaaagaaactctaaccggagaagaatttgcaagtttatttgaaacaggaaaatatccgggggaagaagaaaaaaacaatgaagaagaggacaatataaatgaataaagaattaactgtcggattaaaaaatgaaagagaaatggttgtaaaggaagaacatcttgcatgttcaaaaggaagtggagctgcaaaggttttttcaactcctgatttgcttttacttatggaaggcgcttgttttaaacttgcagaagaatacttaaatgaaggagaatcaactgttggaactttagcaaactttaaacatcttgctgcaacaccacttggaatgaaagtaagatgtgaatgtgagcttatagaaattgacagaagaagattaatatttaaagtcgaagcttatgacgaaaaggagaaagtcggtgaaggaattcacgaaagatttatcataaacaaagagaagtttgaagcaaaggctgaaagtaaaaaataaaatataaaatataaaatataaaatataaaatatattgtaataatgctgatacttatggtatagatttaggaacatataaacattaatacatattaatcattttatgtattaatgtttattttttttctctttattcgtatattatactttttacatgttctattttaatatgtcataaaaagtatactttttatgacaaagattatttatcaattgttattagtgtaagtttattaatatggtaataaatatagttaaaatgtattaaatgattagacaagtatattattttattattattgaaatatagaatgaaaaagaggtgttaatgaaagaaacaatagaaaagtatcaagatatatttacagaacattttttattgattttattattattttctcttgttgcattgacaattacgggaataggaagccgggaaatggttggtttaattggatgtattctatgcgtagtagcattgacaaaggattcagtttttattgatccatggattttatttccgttattaatttatgagatttttagcgcgttatcttccataagtattttcggtgatgtttttcatggtttttttaatactcaaatcatatatccggtcatatatgtctttttgtcactcttaaaagacagtgaacgtttatggatgcgcagattatgtgttttatgggcaggacttatttcgtgttatggaattttagattttatatattcttcttttaacggagagatttttagacttgaaacaatgttagggaatccaaatgctttaggatgttttttggttgttgcatggttttcgttaaaggttagtgaaataaatgagatagaaataaatattgtaagcaacattataagcaggttggaacctttaatacttacagctttagctttgacgttatccatgggaagttttctttcaatgatattggctacaattatattattaattcaaaaagctcgcatttataataggaaagaattaatttcatttgctttattgacgatagctaaaaatatttgtgggatatctgcaggtattataatctatttttccgtaacttttgcgaatactttttggattgcttgtctgacgataatatatgtttttttattatcattttattggtatttaatggacgattttcttagaaaatataaaaaaatttctttattaatatttgccagtggtttgttttttgtaatagctgctatattcatacgtacaaacgccgtagcaacttttattgaaagatttaagatgatggaaaatgggttaggatatattttaaaaaatccaattataggggtcggaccatatcagtggagatatttaaatttgtatgatagtgatatgtattttaatacatggcatattcataattcgcttattcatataggtgttgaattgggtttggttgccttattaatgatggtaataattataattcgtatatatatgaaaggaggagatggtattgttggtttttctgcatttttctttcataatatgattgatgtgagttttttttatccatgtattacggttttaaccatattaactactgtaggttctaataaagaaaaatatgaaatgggtcgttgtagtaaaaatattttttttcttgttttttttactgtttttctttgtacaggttttcatgatattttttagaaagggatagatatgatacaaaaagagaaaaaattttttccgatatggtgtattttgtgttttttctgtttgttgtgtgtagcttcgataatagaatggagaatgaatgtacatgggcttcctgataatgtagggcataaactgactttagaagaacaagttgaaatcattgctgataacagctccatgattaaatatgtttacttaagcccgaatgcaacattcccgagagaaaaaaagataaaaaaaattacaatacatcatatggcaggaacgatttctttagaaagattaggagaagtttttgcggacccaagcagacatgcttcttcaaattatgccatagatataaatggtaatgtcggactttatgttgaagagaaaaatcgtgcatggacatcgtcaagtcctcaaaatgataatcaagcagttaccatagaagttgcaaatgacgagaatggtggagaatggcatgttagtgatgaatcttatcaagcactcattgaattatgcgaagatatatgccgtcgaaatgaaataaaagaattaatatggacgggcgatgaaacagggacgcttactattcataaattttttaatacagaaacagaatgtccgggaccttatttggaaagtcttatggataatattgcaaatgaggttacaaagcggttaaatgaatcgtaatataataaaatatgatttatgtaagtttttaataaaagtgggaggaatttagttattatgcaaaataaaattaaaaaaatttctggaatattattggttgcaataattttgtgtttgcccaactttgtattcgcaaattcgattatcaaagaaaaggtcaaaacattgagtaacgataatgtgtttgcttattataattattatggtacagaaaatccaaaagatccgtatagcaatgaggatccgaaagatccatatagcaatgaagatccgaaagatccatatagcaatgaggatccgaaagatccgtatagcaatgaggatccgaaagatccgtatagcaatgagaattcaaatgatgtttatgacaattcagaacataattatagaaaatccgaaacgcctaagacgggagataagataagtattaacacatacataattatttcattattaagtattattgctttgagcgtagctggagaaatggcaaaaagaaatataattaaataagaaaacgagtgttatactcgttttcttattcatataattcttctcttactttaactacaattatacttacatcgtctttaagctttccaagacttcttgcataagcttcattaaacagttcatcagcaatcttttgaggatttctatattccatgttaaggattttttcttttataagttctctatcgttcataaatgcttctaaaaagccgtcacttaccatataaatataatcattgttttttaattttatggtctcttttgctatatctatattttctattattcctattggaagagcttgggcagaaagactggttacttcaccctctctttttaagtagctttcagttgctcctgcttttataaattcagcttttgctgtaaataaatcaaaaagtataatatcgagtgtagaaaaaacttctttttcttcaagagataaaattgtatttatagtgtttatgctgtcaatttcttcgctttcacatccaagcatttcttccagaagatttaacactctttcactttgcatatttgctttttctcccgttcccattccatcggcaagggcaattaaatgtttgtttgtaggaagaattatatttgagtaattatctccgcatttctctttatcgtttcttttccctcttttaattccaacgcttaaagagaaaggcattctttccgtaaaagtatattcaaaagcttcaagagaggattccgtgaaagaatcataatcatacatgatgtttttatctaatatctcacttaaaagtaaaggtacggttattctatattcttcggaggatagtcgtttgcttgttttaatgtatattctcatttttccctgaaaatcttccaagactacactttcttttactataattcccatagcaaaaaggctttctcttatattttcttcatcttttgaaaagtaatttaatcccttttttatgtttgtataaatattgtctaaagttttatttatgcttttgaattctattttcataagttctttgaatttagaaagtttatttttgtaatctttttttattttgagattgtcacacaagtaagatgcgcttttaaaaataaagaagttatatttgcatttatttacaaaactttttggtaaatctttttttgatgttattttaccattatatgtatcaagtattacttgagaaaagtttacaaaggtttcttttccgtcttcattccaacacttagcaaagttttcgcagtttgtgcatatgtcggcagttagaactttgcaaatgctttttgttatattctcatttttttcttcttcctctaaggttatgttataacttacttcgtttatcatgtttttcttattttcaatttcttcttttattgctttttttatggcactattaaatatatttccgtgaaaatctttttgttttatatttaccaaatttaaaattttttgattaaaagttgttgatacaataagaaaaataatacctgcaattaatacatcaattaccgggatagtaaacataatacttttatttacatagcaagaaagggtaagagtagtaaatataaataccaaggtgcttattcctcttgataaattttttgtcattgaagaaaataaagtagctactgtaaaaattaaaattatatcagtgctgtatccaccttttagagtaagtagaatacttcctataagtgaaaaactaaggcaaaggcttaatgaaaagtaggtagatacaaaaagcaacataaaagaggttataataagagcaatggaaactgtaaatatttttatatcacttaaccccagtactattattgaaaaaataatagacaggcttattgcttcaaaagaggagaattctttttttaaatcaaaattttctataagattataagaggtattaaaaacaaaaaataccaatattaaacttaaactttcaattaatgaataaacattgttaatgggtgggtttttaaaaatataattaacaaagaaaccgcttaacaaagtaataagggcacatataacagaatatgtgcttttattttcatttactatataattttgatttacaataagcataaagcaaaatgcaataattaatctaaaagctgatgttatatttaaagtaaaagccgttaacactgtcataatgattaaaggtaaattatttaattcctttttataaattataaaagcaccaaatccaaagacaaacggcaaagtataagaaaagaaaatacaaaagctatttaatattgacataacaagcataaaaacattgcgataagttaaaaatttattttcttttcttttattttttgaattttcagcgtatgtattgttgatttttagtataccttctctacttatcatattaaagcctcccataagttatataaaaattataaaaagcctcgttggtgaaatttgatgaaaaaaagaataaaactaaaaaaaataaaaaaccctttaagtatttgtatttaatttgctaatattatatacttacagtgtaaattaacttagaggataaaatcatgttagtaaatggaaatgaaatagaaattttagcacctgcgggtaattttgaaaatttaaaaacagcggtattaagcggtgcggatagtgtatatttgggacttggtaattttaatgcaagaagaaatgcgaagaatttttcaacatttgaagaggtaaaagaagcggttgatttttgccatttaagaggtaaaaaagctcatgtaactttaaatactcttgtttatgataatgaaatagaaaagttaatcgaagaagttgaaatgattaataaagccggctttgatgctattatagttcaagaccttggagtaataaacatattaaagcaaatatctcatgttcctcttcatgcttcaactcagcttagcgttcataatgtaagtgatgcgaaaaagctaaaggaaatgggttttgacagggttgtgttatcaagagaattatctcttgtggaaattcaaagaatacttgatgaagtagatattgaagttgaaatatttatgcacggagcgttatgcatgagcgtttctggacagtgttatttttcttctgctcttggagaaagaagtggaaacagaggtttatgcgcaggggtatgcaggcttcctttttatgtgaatgataaaaacagatataacttatctttgaaagatgcttgttacatagattatattgatacttttgcaaaaatgggtattgcatctttaaaaatagaaggaagaatgaaaagcaacgaatatgtgaaaagcgttgtttgtgccgttaaagatgaagttgaaaaaggatattataataaaagacaacttgaaagtgtattttcaaggagcggttttacagatggatatataacaggaaaaagaaatgatatgtttggtataagaagcgaagaagataaatcttatactaaacaaataagtgaagaaattaaaaatatggatattgaagaagaaaaagttaaagttaatgtgacttatgacttttctttaggtgaaaaagcatatgttaaagtaaccgatgaagaaggggtatcggtagaacagtttggtcctataatagagcaggcgaaaaataaacctactttaaaagaaaatatagaaaagaatttaagtaagtttggtgaaagtatatattacgtagataaaatggatggaaatactgatgataatatttttattccggtatcagctattaatgaaatgagaagaaatgccataaaagaaatggacagtataagactaaacaggtttaaaacttatgatatagatacgttaacgaagattaataagaaagatattgtaagagaacataaaaatattgctgtattaagtaatataaatttattaacaaataaagttttaaattactttgatattatatttgttccattatttcaagttaaaaatatatctaaagatgtaatagaaaagtatagtgaaaagcttggggtagaaataccaagaatttattttgacagggaagataatatagagtcaatgcttgatactgtagaagagattggaataaacaaagccttatctcataccataggtaaaatatacttagccgatgaaaaaggatttgatgtatatagtgggtttggcagtaatataacaaattcatacagcatagatatacttgagaaaaatattaacaatttaaaaaatattactttatcttttgaaaataccgtaaataatataaataaaataaaaacaaatactcctttatctgtaatagtttatggatatttacctctaatgactgtaagaaactgtcccgttaatgaagaagtaggatgtaagaattgcaataaaaataaaagccttacggatagaatgggtaaaaaatttaaagttaaatgtaacggacaaaccagtgaaattttcaacacatatcccgtatgtatatttgacaaattagataaactaaaggataatattgatagagtattcttatttacaaacgagaatagtaaagaagttgatattgtaattgataaatatttgaaaaaagaaagattagcagaaagtactaaaggttgttattttaggaagttattataggaggtaactatggaaaaagttgattttcatattcatactaacgcatctgacgggagttgggatagcgaagaagctgtaataaatataaaaaaagcaggagttaaatactgtgctatatcggatcatgacagtatctcaaacgttaaattagcagaatatcttgcaaaacaagaaggaataaatttaatcagggcaactgaaatatgctcaaagtcttatgataaagaagttcatattttaggttatgatattgatatagatgatatagatcttacttatacaatgacaagaacaaaaagagtaagacaaaacagagatacaagaataataaattggtgcgcaaagagatatgataatgtaagtttggaagaatacaatatatataaaatgcaggaaatggcaggtcttccaattatgaattatcttgcagagaaaaacgtatgtaagggaatagaaccttttaatgcaattaaagctcaagttcccgttccaaaagaagaagatttgctatcttcagaagaaattatagcagcaattaaaaaggcgggaggtgtagcagttcttgctcatccatcatattatttcccgggaaatgtaatgccaaaggatatgcttgaaaattatctttcaatgggaattgacggtatcgagtgttacagcacttataatcctttaaaggaacaaaatgaatattattttgatttttgtaaaaaacatgatttaatagtaagtggaggctccgattgtcacggaagtgtttatacaacaagatttgtaggaactcctacggtagatttatcacaaacaaacttactttcaagaacaagaaactatgcaaaattgcagcctaacccatgtttttagttggtttttagctattagtctttatttttaaagtaaattttagtataatactaaagttaaagtaaaaagaatttaaaggatgaaaatagaatggaaaaaattattataaaaggcggaaacagattatctggagaagttacaattacaggtgcaaaaaatgcggctcttggaattcttccggcaacagttcttgccagcgataaatttattattgagaatttacctgatattcaagatatcagaaactatataagtattatgaaaaaacttggtgcaaaaatcagaaagacatcaaaaggtttaagtgtagacacaacaaatattgcagattgcacaagtgatgaaattgcagaagaaagcacaaaaatgagagcaagttactatttgcttggtgcattactaggaagaaacggaagcgttgaacttccacctcctggaggatgtgatatcggtgctagaccaattgatcaacatattaaaggctttgaagcgttaggggcaaaagttgatgttaaaggttcaataaaaatagaagctccaaacggacttaaaggtacaaacatttatatggatgttgtaagcgtaggggcaacaattaatataatgcttgcagcagtaaaggcaaatggtctaacggttattgaaaatgccgcaaaagaacctcatgttgttgacattgctaacttcttaaatttaatgggagcaaacataaaaggtgccggtactgatgtaataagaataaatggggtagaagaacttcatggttgtgaatactctgttgttcctgatcaaataacagcaggaacttatatgattgctgctgctgcaacaaagggggacgttttaattaaaaatgttatcccacctcatcttgattcaataacagctaaattaatagaaatgggtgctgaagttacggttgatgaagatgataatattagagtagtaggaagagaatacattaaaccttgtaatgttaaaactctaccatatcctggattcccaacagatttacaacaacctatgggactgtttatgtgtttggcaaacggagtaagtactattactgaaagcatatttgaaaatcgttttagatatgtaacagaactgcaaaaaatgggcgcaaacataagggtaaatggtaatacagcagtattcacaggtccttgtgaactttacggtgcaaaaattcaagcaactgatttaagagccggtgctgctatgatattggcagggcttgttgctaaaggtactactgaagttactaatttaaaatatattgatagaggatatgaaaatatagaagagaactttagaaatttaggtgccgatatagaaagagttgattcataaaatatttaatcccctaaatataaaggggattttattttatataataaatatatataaattacataaaatgaaagggagaataaattgaagtttacaaatctcttttcttcatcaaagggaaacagtttgcttgtggaaagtgaaaatacaaaaattttaatagatgcaggacttgctggtaaacatataataaatgagcttaaaaagattgatgtagatattcatgatatagatgcaatacttattactcatgaacattctgatcatgtaaaaggtgcaggtgtattatcaagaaaagccgatatacctatttatattcaaaaggatgcttgcccttcggttttaaaaaagataggaaatgttaaaggagataatatatacagaatagaagaagaaagaccactatatataaatgatttattaattgatagcttttctattcctcatgatgctgttgctcctgttggatttactattgatgatggtaaaaataaaattggcgtggcaacagacatgggaatgataatggaaagtgtaataaataagcttaaggattgtaaatttgtttttttagaagcaaaccatgatgaaacaatgctaaaaaatgggtcttatccaattgaattaaaacaaagaattttatcgcctttcggtcatctttcaaatacagacagcggtaaagtattaagtgagcttataaaaggaaagacagaaagaatcaggcttggacatttaagcgaagaaaataatctttcttctgttgcttttgaaacggtaaaagacgttgcaaaaagcaatgatgccattgagggaaaagattttgttttagatgttgcaaacagaataggtattaatgggactattcattgttaggaggtcaatatgcaaaaaaaggggaaaagcggacttaccatattctttttgggattaattataggtgggattatattcggttcattagctttttttataactaatatgaggatgaatgctttaattgatgaaaaactgggtatggaaagcgaaatagtaacagatgattcttcaggaagcgttacacttaaggagtctactaccgaaaaagttgcgcaaagtgttactccagctgttgtaggtgttgaaacagtttcggtaacaaaagatatatttgatagagagtctgaggttggaggaattggaacaggttttattgtagataaaaacggtctaatactaacaaatcagcacgttgtaagtgaaaatccaaaacaaataaacgtaacattaaaagacggaagaaattttgatgcgaaggtaatatattcatctactactattgatttggcagtaataaaaattgatgcaaagaatttgcctgttgtaaaactaggggacagtgaaaaaataaatataggtcagactgcaattgcaataggaaatccaatgggactaacttttgaaagaaccgtaacacaggggataatcagtgcccttaatagaagtattgctgtagattcttcaacagttgctgaagatttaattcaaacagatgcttcaataaatgaaggaaacagtggaggtcctttattaaatcttgcaggagaagttgttggaataaatacttataaaattcagtccggagaagggcttggctttgcaattccgataaatattgccaaaccaattatagaacacataaaaaaagagggagaattcgttcctacggttatgggaattgaaggtgtagataaagaaatcgcaagatattattcagaagatatagatttggaaaaaggaattttaattgtcggtgttgtaaatggaatgggtgctgataatgccggtataaaagaaaatgacataataacaaaggttaataatgttgaaataaaaaatatgcttcattttagagaacagctttattatcatagccccggagataaagttaaagttacttacgaaagagacggaaaaagcaagacagttgaagtagtattaagtaaaggaaataattaaacagctttagggctgtttttttattgaaaaagaattttataaaagctcctattggtggtaaaataaaaaagaggtgttatcatgaaagaggttataaatagaaagcagaaaagttatataaaatggattgttgcaataattggtcttgggttgtttctttatttatgtattaaacttagtgtaaatgaccttaataattttgattttatggtttataattttgtatcttcttttacatcacctgaaactacaaagatatttaggtttattacaaggtttggttctattgaagtaatatttcctctttgtattttaatctttatgcttatgaaagataagaaaaaaataatattatcaatagtaaatatactgggagctgtatgtttaaaccaagctttaaagtttataatagaaagacctcgtcctgccgttgtaagacttgcagaagcaagtgggtttagtttcccaagcgggcattcaatgtgttcattagcattttacggatttctactttatcttcttataagaagcaacggtggattttggtttaaattttttggaagtattttaatatgttctcttattatattaataggagtaagcaggatttatcttggggtgcattattcaagcgacgttattgcagggtttgctcttgcactttcttatttaattgtgtttactgatattaccgataaaattgtatataaaatataaaagaacgctttgacgttcttttatttataattgatgtaattatatttatggtatgatataatatttccttaaggagaacaatatgaatttaagattagatgatttgcaaataaaagattattatatatatcaagatactgatactttttgtttcggcatagatgccgtactccttgcaaattttacatcaaaatatataaataaaaaggatagttatattgatttatgtacgggaagcggcgttataccgattcttgtatatgcaaaaagaggaaataaaaatattaaagcagttgagattgatgaagaaatgtgtatggtagtaaaaaaatctcttgactataataatattgacaatattgaaataataaaccaaaatatcaataacattgataaaagtttatataataaatttgatagtctatctgtaaatccgccttattataaagtgaatagcggagaagtaagcataaatgataaaaaaagttatgcaaggcatgagatattatgtagttttgaagatgttgtaagaatttcttcaaaattgttaaaagacaaagggaagtttttcttggtacatagaacaaatagatttgaagaaattatgaaaatacttggagagtatagatttgctgttaaagatgttcagtttatttatccaaagaaagagaaaaattcaaatttatttttgcttaaagccgtaaaaggaggaaaaagcggattaaatattttgcctcctcttgtaatgtataacgaacaaaacgaatatacaaaggaatttttggagtattactatgaagatagaacaaataaataacgatttaatactaactgatgttgaccattttaatttgaaaaagacctttgaatgtgggcaatgttttagatggaatgaattggaaaaagatgaatttatcggcgttgtaaatggaaaagtaattcacataaaagaagaagacggaaagtttacattttatgatacaacaaaagagtattttgattctttcttaaaaatatattttgattttgatcttgattataatgaaatagataaaaagataaatacagatgaacatatagaaaaatgtatagaatacggaaatggtataagaattttaaaacaggatttatttgaaacaattatttcttttataatttctgcaaataataatatcccaagaataaaggctataatagaacttatttgtgaaagatatggaaaagaaatagagtataagggtaaaaagtattattccttcccaagttatatagatttaaaagacgtaacaaaagaagaatttcatgaacttaaaatgggatttagggataaatatttagttgatgccatacataaaataaacacaggcgaaattgaccttgaaaagataagtgaattggatactgaattagctaaaaaagaacttatgaaaataaaaggggttggagagaaagtatcggattgtattttgttatttgccctaaaaagattagaactttgccctatggatgtatgggttaagagaatatttttaaatagatatgggcttactgatttaacttttgaaaatggatttaaccttgctaagagtaaatggggtgaatatgccggtattgcacaacagtatttattttattatgaaagagaaacttcaaaggagaaataatgaaaaagaaattattaatatttgattttgacggaactttagttgattcacttcctctctggcaaaaagtggatgatatcttttttaacgaaagaagaggtatacaatattcaatagaagatattgactttagacctatgagtattgaagaggctgctcaggcgacaaaagaggtatataaggttgaagaaagtattgaagaaattattaaggaatgggtagatatagtaaatgaactttatttaaccgaagatatattaagagatggtgcaaaagagattataaaagaagctaaagaaaaaggttataagcttgcaattgggacaaacaacacaatggagcttataaaaagcttcttagataaagaaggtttgcatggtgtttttgacttagttgttaccgctaactgcgtaaagagaagcaaacctgaccctgatatatttttgcacattgcaagaaagcttaatataaatcctgaagaatgcatagttgtggaagattctcttgcaggaacaatggcaggaaaagctgctaatatgtatacttatacaattgaagaagaagaaagtatagaacataaagaagagattttaaaaataaccgataaatatatttactcattaagagaaattaagctatagatctttttattttgacaaaatattttatatatgatatagtattaattcgtaagggagtaatcggcgtgaaggcgtaataaagtcaacatattggaaagaaattcctggctttattttaaacgatgagacttatctgttttttaacggataggtctctttttttatcaatagaattttgtaatgagaggaaaaagatgaatttaattgaactgtttataatcggtgtaggtctttctatggacgcatttgcggtatctgtttgtaaaggtctttctacaaggaaattaagaagtaataattatcttactgttggagtatactttggtggatttcaggctttaatgccccttataggttattatcttggttattattttaaaaatataataacggattttgatcattggattgcatttattcttcttggttttataggttttaatatgataatggagtcaagaaaagaagaaaatcttgattcaaggtttgattttaaaacaatgattccactcgcagttgcaaccagtattgatgctcttgcaataggggttacttttgcatttttaaacgtaaatatatttttagcaatatctataataggttgtacgacatttatattatcaatgattggcttaaaagttggtaatatttttggtaaaaaatataaacaaagagccgaacttgttgggggtattattcttgttttaatggggattaaaattttgcttgaacatcttggaattttatagaaagaatataggggtttaaccttatattctttttttgagtgtttaagatacccatttctcctttaaaacgggtgatatacataaacagaaaagtatgatataataataaaaatttatatattttatgataaataaaatattataaagagagaattaataaataataaaacaaaaaaaatactttaactaaagttaatgattgtaataaatttgctttatatctattaataaaaggagaaagccatgaaaaagaaaatacttaaatattcatttatgcttattttatgctttacctttgtattcctttttatgccgaaggaaagttttgctgcaaatggagattggatttatgattcagaagctaaaacgctgacaaacagcgaagatgatcaattggtaataggcaatgtaacggcagagggaacaaatctggctattggagataatcgaaatgcaggatttacttctattgatttaacgggagaaataaaagattcttccaattcgactactaattatgcaattacatcaatcggacattgggcattttatcaatgtgcatccttaaatgaaataaatataccgaacagcgtaatttcaatcggagaatatgcattttccgaatgtaatgccttaaaggaaataaatataccggatggtgtaacctcaattggacattatgcatgttacaacagtacttacttagaaaaaataagcatatcagatagtgtaacctcaataggacataatgcatttgattactgtacctccttaaaggaaataaacatacctgacagtgtaacttcaatcggaagttctgcatttgaaagttgtacgtccttaaaaacaataacttggccggatagtgtaacctcgattgcaaactggacatttaatggatgtatagcactggaagaaataaatattccagacagtgtaacttcaatagggatttctgcattttccggatgtgtatccttaagcggaataaccatacctgatagtgtaacctcaatcggaagttctgtatttgccttctgcacttccttaaatgaaataatcattccggatagtataacctcaatcaatactactgcatttagaggctgcacattgcttgatacaatttatttaatgagtgaaacgcctgtatctcttggagacaatgttttccttgattgcagcagtctttctaatatttatgttccttcttcaagtgttgacttatataaagcagaatggagtaactatgaaaatttaattaaagcaggaatatataaattaaccgttgaaaacggaagcggaagcggaaattacatagaaggcgcagatgtaagcataagtgtagataataatgatgagaacggacattttacttcatggcagataacaagcgggaacggcattagtcttactgatgaaaaggcagtaaaaactacatttaaaatgccgaacagtgatgtaactgttactgccgtatttgaagcacataattatgtagacggaaaatgcagtgtttgcggatatgagaaccctgattatgttccgcctaaagaagatgataaaacagataacagcaatattaataatgacagcgtaagcactgatattaaggtaaacagcaaagctgacaaaactgtgtcttcttctgtcgatacgtcagatgaaaacaatgttacggcttatattattttacttatggtatctataatcatggtaggaagtttaagtatatataaaaataaaaaagactgttaagatttcttaacggtctttttttatttgctcattataattaaattataaaacactctttcagagtttttatatcgcttctactattaaatcacccatttgtcttgtgccgacttcttttgtgccttcgcttactatatcaggagttctatatcccatatcaagaacctttgttacggcattttcgattgcacttgcttcttcttcaaggttaaatgtatatctaagcatcattgccattgaaagaattgttgcaatagggttagccatgtttttacctgcaatatcaggagcagaaccgtgaattggttcatacattccaaaagaattttctccaagacttgctgatggaagcataccaatagaacctgtaatttggcttgcttcatctgataaaatatcaccgaacatatttgatgttacaataacgtcaaattgtttagggtttcttacaagctgcatagctgcattatcaacatacatatgtgtaacttcaacttccggataatctttgctcatttctgttatgatttttctccaaagtctgctgctttcaagtacgtttgctttatcaatacttgcaagttttttgtttcttgccattgctgtttcaaatgcaattttacctattcttcttatttccatttctgaataactttctgtgtcgtaagcttcgtttccgtatttaccttctctatatcccctttctccaaagtagataccgcctgtaagttctcttacaaccataatatctaagctgtcgcctataatttctttctttataggacaagcatcgcttaaagctttatgtattattgcaggtctaaggtttgcatataatcctagggattctcttatgccaagtaatgctttttcaggtctttgatctcctggaagattatcccatttaggacctcccacagcacctaaaataacgctgtcagagtttttgcaaagctgtactgtttcttttggtagacattcaccgcaattgtcgattgcgtctccgcctgctctaacatatgcaaatttaaatgtatgagaatatttttctcctattttatttagtacttttacagcttcagctgttacctcaggacctattccatccccttttattaccgctaaattaaattccatattattctccgatcttttcctttgtatattctacaagtccgcctgccttcatgattttttgcatgaattcagggaaaggttgtgccttatattctttgtttgttgttaagtttgaaataatacctgtgttaaaatcaacttttacttcatcgcctgctttaatatcatttgctgcttcttcacattcaagaataggtaagccgatatttattgcgttacgatagaagattcttgcaaatgttgatgctataacacaagatactcctgcgcatttaattgcaagaggagcatgttccctgcttgaaccacaaccaaagtttttcgttgcaacgattatgtcacccttattcattttatttacaaagtctttatctatatcaatcatacaatattttgcaagttcatctccgcttgatacatttaagtatcttgcagggattattacgtcagtatctacattatcaccgtatttaaatacttttccttgtgcttccattaaaaatctccctccattactttttctgggtcaacaatatatccggcaactgctgatgctgctgcaacagctggacttgataagtaaacttcactgtctacatgtcccattcttcctacgaagtttctgtttgttgttgaaattgctttttctcctgcagccaagatacccatatgtcctccaaggcatggtccacatgttggagtagaaacaattgcgcctgcttttattatatcttcaacatatccaagtttgatactatcaagataaatttgttgtgttgcagggataactattgttcttacttttttgtttacttttctgcctcttaaaatatcagcagccattttaatatcttcaagtcttccatttgtacaagaaccgataactgcttgatctacatatactttttcttccatagattcatctactgtttttgtattttcaggaagatgaggataagaaacagtaggtctaagcttgcttaagtcgatttcaataacttgttcatattcagcatcttcatcagcttcaaatacttcaaaaggttttgttgaatgtgcttttgcatattcgattgtcttttcatcaacagggaatataccattttttgcacctgcttctatagccatattagccattgagaatctatcatccatagacaaatacttaattccatctccaacaaattccattgatttatataaagcaccgtcaacaccgattttaccaataatatgtaatataatgtctttaccgcttatccattttgcaggtttgttttttagtacaaatttaattgcttcaggaactttgaaccatgcttcacctgttgccatacctattgccatgtctgtacttccaacacctgttgaaaatgctccaagggctccgtatgtacaagtatgagagtctgctccgattataacttctccgggaactactattcctttttcaggtaaaagtgcatgttcgatacccatatctccaacatcaaaaaagtttttaacattcatatcccaagcaaaatttctacagcttttacattgttcagctgctttgatgtctttgtttggtgtgaagtggtcaagtacgattgctactttattttcatcaaatactttctttgcaccggtttttttgaattcttttaaagcaactgcagttgtaatgtcgttacccattacaatgtcaagttttgcttcaattaattgtcctgcaacaacgctgtctaaacctgcgtgttttgcaaggattttttgtgtcattgtcattcccataataaatatctctccttaatttctacttaacaattttatttgcaacacttactacggcatagaatgaagataatgttatattacttgatactcctgctccgtagtacattttgtggttatgtccttcaatttgaatatatgaaatagcccttgcatttgtaccgtattccatagagtgttctctataatcggttacttccatttcaatgttaaattcattttcaagagcatgtgtgaatgcatctataataccattaccaacgccgcttatttctctttcttcgcctttatattcaattatagctttgatagaaacttcttcgtcgtggtctttagttgtttctttatattttataagtttaataggattttcgttgttgatgtattcttttttgaatatatcaaatataacttccggtgcaaggtcactatgatgtttatctgatacttttgttgtaactttgctgaaatctttttggaattctttaggaagatataatccataattttgttcaagtacgaatgcaaccccgcctttaccagactgtgaattgatacgtacgattgggtcgtatgtacctccaacgtcttttgggtcgattggaagataaggaacttcccatattgtttgttttctttcttctcttttgttcattccttttcttattgcatcttggtgtgagcctgagaatgcagtgaataccaatgaaccaacgtaaggatgtcttgggtttatttccattcttgtaagtctttcgtacatatccccaagttctcttatttttgaaaagtcaagtttagggtctattccttgagagaacatattcattgcaacaaccataatgtcacagttacctgttctttctccgtttccgaaaagtgttccttcaactctgtctgctcctgccattaaagcaagttctgttgcggcaactcccgttcctctgtcgttgtgagcatgaagacttaatataacgtcttcgcggtgatgaagtctttctgaacaatattctatttggtctgcataaatattggcagttgccatttcaacggttgatggaagatttattataattttattatttacttttccatgccatgtatctattactgcattacagatttcaactgcataatccatttctgttcctgtatagctttcaggagaatattcaaaagtaaaatctgtttcaggatattttttcatttcttccaagaatttcttagcgcctcttacggcaatttgtgttacttcttctttacttgcgttaaatactacgtctctttgaagaacagaagtagagttgtaaagatgtactattgctttttttgcaccttttatggaagcaaatgttttttctattatttcatctcttgattgtgtaagaacttgaatatttacatcatcgggaatcatgtctttttctattaatgttcttacaaattcaaattctgtatcgcttgcagctgggaagcttacttcgatttctttaaagcctatttccacaagtttgttataaaattcaattttttcatctaagctcatagggatttcaagagcttggtttccgtctcttaagtcaacgctgcaccatattggagctttttcaataactttatccggccattttctatcagtttttttcattggcggatatggtctgtacttttcaaaatttttcatattttttacctctttaattatttatgaacgcaccttatttaaaatttaacacactttttagttggaatttggtataaaaaaacttccgttctcaaataagagacgaaagttactaattccgcggtaccactctaatttattctttagtaaataagaatacactcattaaagatacgggcagtgtgccgatatctcgtcactgtaacgggtgacacccgtttccacttactctccgtagatttcagtaaaccactctgaggcgagttcggtttttgttaagtactgttttacaccaaccaacagctctctgcgacttgttaaaaaacttactattcctcttctttgtgtttaaaggtattaagttcatattgataataatctatcacatgaaaagttaattgtcaataatatttagaaaattctttaatttttagatgcattttacatttattatatttgtaacatttagggtgttgaatttatgaaaatatatagaaaattttatgtgaattattttatttttcattaatgtaaaacaataaaaaaacaccttaaaaggtgtttaaatttctttttttgagaaagatgtttttacttgaacgtggtcgatttttccaagtcttcccgtaaaagcatttattgtatcagcttcgccgattacggcaatagatataattgatacattttctctgtctaatggtattcccattcttcctcttataatatctttatagctgcttattacctcatttacttctttttgtacttttttaggttcatctagaaccagacttattactgctattctcatacttcctccttcatttacatttgtttatgaattctttaattatttttatgcttgtttcttctttttcataattgaattcaggatgccactgaagtccccaaacaaattttttatcctctaaatatactccttctattaatccgtcttttgaaactgccataggttttaaatcctcggctaaatcttttattgcttgatggtgataactgtttacgcctatttcatttaaatttaaaagattatataaaggggtatcttttattatatccactttatgcaagtttatgtcgtaaggcggcttttgtacgtggtgtaatcctttttgtgtttgtaagtcttgatataaactacctccaagaagaacgtttattatttgtattcctctgcaaattgcaagaagaggtttatcttcttttattatttcttcaaataatattgtttccatttcatcacgttcataacatatattatggcatttttctgatttttcttctttatacatattaggatttacatcgtgaccgccggaaaataaaaatccgttacagtgctttgtaagttctttaatgttttctttatttgttgtcagaggtaacattataggtattccgccgcatttttcaatgcttaacatatatccaggaagcatccagtagctgtctttatattcgtcaaaaagcggtactattccgattattggttttttcattttgtctcctttttatgtcaatgctttggttttatagttttagttgtatattttagttaataataaaagaatatcatatataaaaaaataattccatattataaaaatctatttttataataaaaattacatatttatattcatttactaaataataatggtatgaaaaagaaattatttttttgctttatttttatagcattgatatatttattttgtgaaaactattcgtgtgaaacatttgatagaactttcatgatatatatgaatggttctgatttggaaagcgaagataaaattgcaagcggagatttgaaagaaatatgtgaaagtgaaatccccaaaggcagtaaggttttaatatatacaggcggaacaaagaattggaataatgaaaaaataaatgaaaataataatcaaatatttgaaataaaaaacaaaaaacttcatttaattaagaacctatctaaaaaaagtatgggaggcagtgaaacacttagtgagttcattgatttttcaatgggacattataaaagtgatgaaaatatactgattttttggaaccatggaggaggagcaatatcgggatttggtaaagatgaaaattttgataatgatacgcttttgcttagtgaactgaaaaaaggacttaaaacttcatatgaaaatcataaaacaaaactggatatgattgtttttgatgcttgtttaatgagctcattggaaactgcatataccattaaagactactctaagtatatggtcgcaagcgaagagtttgttatgggctatgggttaaattataaaagtattattgaaaaatcacaaaacagagatatagaaagtttaggaaggttaattgttgaaagctattacaaggaaagtgtaagaaaaaataaagataagataataacaatgtccttattaaatttaggtaaggttgaatctttgtatgataaatttaatcttttacttgaaaatagcataaatgaaaaagatgtaaataatcttaaagaagatattttaaaggggacaatttttggtggaagaaccaaagaagaagggttcagtaacatggttgatttcctttctctttcaaaaaatatatttaaagaaagtgattatgaaaatcttgaaaaacttatcaatgaagttgttatatataataggaaaggttttttaaataatgatgcttgcggggtatcaattttctttcctttggattataataataagacgttaaatgagcttgtgttgtatgaaaagtttaacgcaaataactcttattgtaaatttttaattaaatactctttaaatgacgatatgaaaaaaaataaagatattttcaaagttaaaaagatacaaaacaaaaatattatatatgaaataacgaaatacaatcaaagaagtaataataaacctttttatttaaatggatatatgctaacttgttataaaattgggactataggtatgagtgaaatttatacttcccctataatatataatggtaaggaagcaagtatcagatttgaatataatgtgtataataataaagtaggtatattaggcgttgttatgggaagaggtaacttaaatatttctgaaaaaaagctaaatgagctggcttttaatgataaaatatgtataataaattacgaacttttagagcaaaatgctgtaaagattttatgcaaaaatgtgcttaaagtcacagaaaacgtcaatatattacaaatgtaatcaaaatatgaaaaaattttcatatttttgtaaaaaaagtataatgttttttttcatcttatagtataatataaaacgtgaacctagaaattttttaataattcatataataaaggagagaaaaaattgagaaaaatagcagttttaacaagtggcggggatgctcccggtatgaacgcagctattagagctgttgttagagcaggaatatattatggatttgaagtttatggtgtacaacaaggttatcaaggtttaatggatgataatatcgttaaacttgatgcttattctgtatcagataagattcaaagaggcggaacttttcttcgttctgcaagatgtttggaaatgaaaaccgacgaaggcttaaaaagagctgttgatacattaaatagacatgaaatagaaggcttggtagtaatcggaggagacggttcctacagaggtgctcaaaaattaagcagagcaggaattaacgttatcggaattcctggaacaattgataatgatatttcatgtactgaatattctataggattcgatacagcagtaaatactgcagttgacgcaatcaataaaatcagagatacatcttcttctcacagcagagtaaatgttgttgaagtaatgggaagaaacagtggttttattgctctttatgcaggtattgcagcaggagctgaagcaattttaattcctgaaaaagaattaaacttagatgttgtttgtgaaaaaataaaagaaggctttagccttggaaaatattatggacttgttattcttgccgaaggagttggacattacgaagaattctgtgatgttattgaaaaatactctggtgtaacaacaagaggaactaacttaggatacatacaaagaggtggttctccaactgcatttgacagaatgcttgcaagtaaaatgggtgctttagctgttgaatgtttaagagatggaaaaacaaacagatgtatgtgttatcaacatggaagatttttagatatggaaattgaagaagcattggctatgccatatgtaattgatgaagaagcaaaaagaattgctgaaatgttagcaatataatataaaaataagtttatgattaggagatgggcataaaattatgaagaaaacaaaaattgtatgtacaataggtcctgcaagtgaagataaaaaaattcttacacatttagttgcatcaggtatgaatgttgcaagacttaacttttcacatggggattatgaagaacatcaagcaagaatagacacaataaaagaaatcagagaaaaattaaatcaaccaattgctatcttattagatacaaaaggtcctgaaattagaacaaagaaatttaaagacggtggagtattcttaaaagaaggaagcatgttcactctttatgttggtgatgaacttggagatgaacatggttgtgctacaacatatgatcatttagcagaagaactaaaaaaaggtgatgtagttttaatcgatgacggtttaattaaattaactgttagagaaattaaaggaagcgacgttgttttaagagtagataacggtggccctgtaaaaaatcataaaagtataaatattcctggagtaaatattaaacttccagctcttactgaaaaagatacaaatgacttattatttggtattaaaaacgatattgacttcgttgcagcatcttttattagaagcaaagaagatgtttttgcaataagagaagttttaaataacaatggtggagaagatattcatattatttctaaaattgaaaacagacaaggtgttgacaatattgatgaaattatcgaagccagtgatggaatcatggttgccagaggtgaccttggggtagaaattccagcagaagaagtaccaatcgtacaaaaagatatcattaaaaaatgtaactatgttggtaaacctgttattacagctacacaaatgcttgatagcatgataaacaacccaagagctacaagagccgaagttacagacgtatttaatgctatttttgacggtactgacgcaattatgctttcaggagaaactgctgccggtaaatatcctattgaagcagttcaaacaatgggtattattgcagaatctgcagaaagcaaattagcaagtgactttagaacaagaagtaaatatgtaaatgataagagtatgacaagtgctgtaagtttatcaacagtacaaattgcagattctcttaatgcaaaagcaattttaacacctacaagttctggttatacagcaagaagaatttctaaacatagaccaaactgtgatatagttgcttatacagataaagaatacgtacaaagaagactatctatagtatggggtgttgatgcttataaaattgatgtattctcagatgtagaacttttatataaagaagtaattaacagtgcaaaagaacatatgcatgtaaaagatggtgatattgttgttattacagctggtatccctcttggtgttaaaggtacaacaaactcaatcagaattgaaacagttggagaacatgttcttaaaggggctggtttaatcagcggtagagtaagaagcaatatcagaatgtataatgatgatttaaaagattttaaagaaggtgaaatcttagctcttacaaaatgctcaaaagaagctaaacctttattagaaaaagcaggcggagttgtttatacagaaaaggcattgttaaatgaattagcaatggagttaagaacagcaggtattcctgttttggttggagtagaatcttttgaaggatttgaagataacgataaagttactcttgatgctacaagaggtattctatataaaacaaaataattaaataatcttataggggcgtaacatgaagacttatttagaaaacggtaatataatgaaattttttgtggatatgttttttgttacaattgcatgcattattatggcatttgcatttgcagcattttgtattccaaataatatagcaccgggtgggttttcaggtttagctacagtcctatattcttttacaggggcaccggttggtgtctcttcttttgttatgtgtattcctttgtttattattttatataaggatatgggtgttataaattttttaaagacattgtatggtacatttgttttctcgttttttatagatttaatgacgggaagatttaattttacaaatgatttatttttagcatctgtattcggaggaatagtttttggttttggggcaggcgtattgtttaagtttaaagggactacaggtggaactgaacttctagccttacttattcatagaaaacttacccagatatctttaggtaatttaattttaataatagatggtattgtaatattaattgccggtatcgcatttaaaaattttgaaataatgctttattctgcaataaatatttatgttgcaacaaaagttatagactttattcaggaaggttcaagctatacaaaggcattttatatatttacttcatatcctgaagatattaaaaatgcaatttttcaaaatcttgacagaggcgttactttcttaaaggcaaaaggcggatttacgaatgaagataaagatattgtcttttgtgttgtaagcagaatggaagttgcagctttaagagaacttgttactgatattgataaagatgcttttgttattctagcagaggttagtgaggttcttggtgaaggatttaagggtgtaacagaggaataaccatgaaagaaataattataaatgatgaatataaagatatgagactggacaggtttgttactaaagtgacaaacctgtctaaagttgaaattcaaaagcttttaagaaagaaaaaaatcaaggtaaacggtaaaaaagaacaaggaagttacagaactaaaaagcttgataaaattcagttttatataaatgaagaatattttaaaatagaaaaaaaagtaaaagccgtaaatacaaataaactagatattatttatgaagatgaaaatattattattgtaaataaaccggcaggtattttatctcaaggaaacgggagcaataaagcggatattgtaagtatgcttaaaagctatttgaatacaaatactaccggaataataacgaggcttgatcttaatacaagtggtatagtaattgcaggtaaaaacagaagaagtttaatgttattaaatgaaatatcaaagaaaaatttaattgataaaagatatttaactttggtttatggtgaatttaaaaatgaaggtaaagtaactctttatggaataaaagatagaaaacaaaacaaattaattttaaataaagaaaaaataaacggtgcatttgaagtaagcgccttttttaaaataaagaaaaaatataaggattatactttacttgaagtaaaacttattacagggaaaagtcatcaaattagagctcagcttaatgccttaggatacagtgtaataggtgacagaaaatataacgataataagaaaacaaactcaaatataactttaaacagacagtttttacattgttataaagtaacaatagattatgatgaaaaatataaagatataattaatgaaaaaaaacagtttaatgctcctcttccaaaagatcttgaaaaagttataagtttattggaaaaaacagataaattttgataatttattttaaaattatattttataattttatttgttaaattatgatatttattggagtgattatatgtatataagcagaaaaaagaagataatttttatcgtttcttttgttgtatttcttttatttattgtttttgcatcgaatgtttttaaatcagataaattattacctataaataaggatattgaagcaggggagaatatagatactttatctcttgtaaaattaggtgatgattataaaaactatattgttagtgcaaagagtgaaaagataacgctaaataaaacaggaaaaacaacaattacatattacataagaaaaaacggtgaaagcaaaaaggaaaaatttgaagtatcatttaatgtagttgatactactcctcctgatataaaaaccgaagatgtgttaagtgttgcttatggcagtgaatttaatataaaaaatttggttagtgtgtatgataatgttgatgagaggataaatgatattgatgtaagtggagaagttaatacaaaaaaattaggacaatataagattactgttacagcaaaagacagcagtaaaaacaccgcagaaaaagaaattttggtatcagtggtaaatccatatttaccatatgaagatatttcttcaattagcggtaaatggttaaataaagaagatgatttgattttgagcttttttaataactacggaagagctaaatattctgttagtgtgaaaggtgaattatcaaattataacggatttgtaagcagtatagatgtaaacggaaataaaataactcttgttttaagttataatgcttcaaattggcaagaaggagaaagtcctgattataaatttgctaaaatggttttaataaaagatgataataaattaaccttaaaaagctttatgaaatataaagatattgatttttcttatgccggagaaagttggcaagaagtagatgaaaaatacacaaattaaaaaagacccgttagggtctttttttataatcctaaattatcgtcatttaagaaaaatactttaattctgtctttatttttttgatatccagtcaaagtatagaaaatacatattttgtcatcactcttgcagttagcacatcttccaagttctctgcaaggagtcttcatatcaagtctttcacagttcattggacctgtttgttcttttactctgtcgattgcagcatctacacttgatacgattttattaggacttgctataattattacatgttcaggtccgtaaattaaagctgaaactctgtttcctgttccgtcaacgttatataattcaccgttaacagttattgcattggagctcataaaatagtagtcaacaaaatttgcttccattgcgatttttcttgcttcttcttttgagttagcttctttctttctgtctttaaagtcataactttgaataagttcgcttaagccttccacttgtttgatagtatagcttccgcccattgcagttgttgagccttcagggataagttccctaactgcatttaaaagttcatctttactatcaaataatcttgcgtcaatattgtttttctttaaagctttaattgttgttaaaattttcttttcattaattttctttatgctgccgatataatccatttttttatctccttttattcttcggataattcttcctcatcttgagatggggcttttgcaattgttgcgatgtttacatcttcatcaagtttcattactttaacgcctgatgtgcttcttcccatttgagatattccgcttacatcaattctaataactgttccgtcatcacttataagcattatatcgtctttttctttttccactacgcacattcctgcaaggttacctgttttgcctgtgattttatagttaagcacgccttttccggctcttccttgtgtaggatataaattagcttttgtaatttttccaaatcctttttctgtaatagaaagtacgtatctgtcattcttagcaatgtccattccgattacgaagtcattttctttaagagtaatacctttaacacctcttgatactctaccaattggtctgatatcttcttctttgaatttgattgcaacacctttatgagttccaagtattacttcttggtgtccgtctgttaggcatactccaataagttcgtcgtcttctgctaagttaattccgataattccgttctttcttgaagagtcatattcagttaggcttgtctttttaaagataccgtttcttgttgccattagaaggaattcgtcgtctttaaattcttttataggtataacagcggttattttttcgcctggatcaagagctaaaagatttactattgcagttccttttgctgttcttgatgcttcaggaagttcatagcctttaagtctatatactttacctttgtttgtaaagaacataatgtagtgatgtgttgtagtaaagaatagatgttttacgaagtcattttctcttgtagataaagccgtaacacctcttccacctctcttttgagctttatatgtgtttgcaggaagtctttttacataacctacgtgagttattgtaactacaatatcttcttcttcgattaagtcttccatgtcaaaatcttcatcatcagcttcaaaagctgttcttctttcatcgttgtatttacctttgatttcaagaagttcttcttttatgatattcataaccaaatcttcgcttgcaagaacgctttctaagtattctattgttttaagaagttcagcatattcattttcaagtttttctctttcaagtccttgcaatcttctaagtctcatatcgacgattgcttttgcttgtacttcagaaagttcaaagcgttccataagttttaattcagcatcgttgtaacttgctctgatgattttgattatttcatcaatattgtcaagagcaataagaagcccttcaacaatatgagctcttgcttttgctttctttaaatcatattctgttcttcttacgattatttctttttggtgatttaggtaatgaaccaagatttcttttaggttaagaactttaggttggttgtttacaagagcaagcattattacgccgaatgtatcttgtagttgtgtatatttatataactgatttaagatgattgaagcattaacgtcttttcttaaatcaattgcaaccctaattccgtttctgtctgattcatctctgatatctgaaattccaacaacttttttgtctcttaccaagtcggcaattttttcaacaagttttgatttgttaaccatataaggaatttctgtaatgacaattctttgtcttgttttacttatttcttctatatgagttttacttcttaatttaattcttcctctacctgttgtgtatgcgttgtaaataccgcttttacccataatgattccgcctgtagggaagtcgggacctttgatatatttaataagatcgtttatttctatgttttcatcgtctattaaagcaacaattgcatctattacttctcctaagttatgaggagggatgtttgttgccataccaacggcgataccgttagagccgtttacaagaagatttgggaatctacttggaagaactacaggttctttaagagtttcatcaaagttaggtatataatctactgtttctttgtttatgtctcttaacatttctcctgtaagttttgtcatttttgcttcggtataacgcatagccgcttggctgtcgccgtcgattgaaccgaagttaccgtgaccgtctacaagaggatatcttgtagagaaatcttgggcaagtctaaccattgcatcataaattgcgctgtcaccatgagggtgatatttacccattgtatccccaacgattctggcactttttctaaaaggtttatcgtaggttaagttaagttctgccatagaatataaaattcttctatgaactggttttaaaccatctcttacatccggaagggctcttccgacaattacgctcatggcataatctatataagaggtttgcatttcttgtactatgtcacgtgtttctatttttccatgaatatcttgaatttcttcttttttcgccatattttatacctcctatatatctagatttttaacttttcttgcgttttctgtgatgaagtcttttcttggttgaacttggtctcccataaggatagagaaaatttcatcagcataagctgcatcatcaattgtaacttgtaataaagttctgttttcagggttcattgttgtatcccaaagttgttccccgttcatttccccaagacctttatatctttgaagacctattttatctcttccgatttcgcttaatttttcttcaagttcttcatctgagtataggtaccatactttcttttgtttttcaagtttatataaagggggctgcgctatataaacataccctgcgtcgataagacctctcatataacgatagaagaatgtaagaagtaatgttctgatatgagcaccatcgacgtcggcatcggtcatgattacaattttgtgatatcttgctttttcaatgtcgaattcgtctgaaatacctgtaccaaaagcagtaatcatagaacggatagtatctgcatttagcattctgtcaagtcttgctttttctacatttaaaattttacctctaaggggtaagatagcttgagtttttgggtttcttcccagttttgcactaccacccgcactatccccttccacaaggtatatttcacattttgcagggtctttttctctgcagtcggcaagttttccaggtaatgctgtactttcaagtacactctttcttcttacaaggtcttttgcctttcttgctgcttttcttgctctttgagcagttaaagctttttcaacaattatcttagcttcttgaggatgttcttcaaggtaagctgtgatgttatctccaaccgtagtatcaacatatcctcttacttcagggttaccaagttttgttttggtttgtccttcaaattctggatcagaaatttttacgctgattacaacagtaagaccttctcttatgtcatctccggaaagattttcttcgttttcttttaagatagaatattttcttgcatatgcattgatacttcttgttaaggctgttttaaagccgtttacatgcataccgccttcaacggtattgatgttgtttgcaaaagaatatatactttcgctgaaacttgttgtatactgcatagcaacatctaaaaggcaaacatcgctttctttttcaaaatatattatttcatttgtaagtttttctttgcctctgtttgcgtattctacaaactctatgataccaccttcataatggaaagtttcttcttgttctttgccttctctttcatcttttaaagtgatttttaatcctttatttaagaaagcaagttctcttattctgtgttttaaagtatcatagttatatacaagttcagagaaaatttcatagtctggtttaaagaacacagttgtacctgtttctttagtttttcctataacttcaagttttgttataggtttacctctttcatatttttgctgatgtatttgaccgttttgatatactgtaacggttaaatgctctgacaatgcgttaacaaccgataccccaacaccgtgtaaacctccggatactttatatgtaccagaatcaaatttaccacctgcatgaagtattgtaagggcaatttcaacggcactttttttgtatttaggattcattcctgtagggatacctctaccgtcgtcttttacggtgattgtatctccttcacctattgttacaactatatttttacaaaaaccggctaatgcttcatccacactgttgtctatgatttcatatacaaggtgatgaagacctttttctcctgtactaccaatgtacatacccggtctttttctaacagcttccagaccttccagtacttttattttactggcatcataattattattatcttgtttggccactggttacctcctttaaattcccattttcaattttatatattttataatcatttatatcttctaaaaaagaatgattgacacaagttataaatgattgcgtgtcctttattaagtttaatatttgtttttgtctgaatttatctaaatcgctcattacatcgtcaagaagtactatcggatagtcttcaaatttgtcataaagtaattttattaaggataatttcatacaaagggcaatgcttctttgttgtccttgagatgcaaatttttttgtatccaagtcatttataaaaatgtttatgtcgtcatgatgtattccgacagttgttgttcctcttgatagatcctcttttcttgctttttttagagcatttttatacattagctttatatcagttaagtcactgttttttagtacatttgaagaatagaaaaatttaatattttcatttttgcatacttctttatttagattatctgtaattttttctattttctttaaaacatttattcttgtttttatgatgtcgcttcctattgtgtataaggtttcatcatatacatccagtaaacttgaagcaatgtttctttttgtgtaatcttttaaaatagtatttctttgttttaaagctttattgtattttcttaaagcactatgataggcaggaaaaataaggcttatactttcatctaggaattttcgtctgtcctttggatatccttttataatttttaaatcttcaggagtaaacaaaactatattgtattcttttaaaagttctgttcttgtttttacgggggtagaattaatttcatattttcttttttctttaatagtgagttttacgtttgtatctatgtcatcttccttttttacatttgccgaaactatgcaaaattcgctatcttgttttatgaaattaagagtgcttttttctctatgagaaattccgtttaaagtcaaagaaagggcctctaaaaaattagttttgccctgtgcgttttccccataaaaaatattatattttttattaaaggacgtattaattttttcaatattcctaaaatttgttatatcaatattttctatatacataaaaaaacccctttaggatttatactgtaattatagcataaaatggggttttttcataggatttaatcaaaatatgagggatattttaattaaaaaacaaatgtgaattttttgttttataatgtgttaaattaatacaaaatattttgacatgagaatgttttgatatataataaagataatttatttttactaatcggagagaattataatatgaaaaattttttaaaacaagttaacttattttacggagtagtaatacttctgatttcaattttatttttacgcccaagtttaattgggcaaataaatccagaacagttaaaggtgtatttaaatattcaaatatactacgctataggattacttgcagctttgatttctttggtatttatgaattatatttatacaaaggtaaagtatggagtaattaaaagtgttgatgatattagatacataaaaccaagaagaatcatgttctttttcatggcaatagccgtaataacatttttaggaacattttgttatgagttccctaaactatcaggactagttgatgttggttttgttggaattcttttaggtaaatctacattttcatattctatatggggtatgtttgttagtgctgttatagtgctttatgtaatgttttttacaaagtctcttgaaaatgagcttccaagacgcagaagatcaaaacaaaaagttaaagtcgatatgaatgacttctttagtatttttatccctcatatacctgctttaataaacttaattgttcttgttgtattctttgttggaatgagaaacttgttgtaaaaggtattttttgtttgttaactaaatcataaattttaacaaaatatattttattaagtttttattatggtataataaagtcaaatataaggttataaggagaagattaatgtacgctaaaaagacagataatataggagatgtaaatatctctactgaaattattgaacaaatggtagggctttgtgcaatggaatgttttggtattgtaggaatggcaagcagaagcgtaaccaatggtattatagaacttttaaagaaagaaaaccttagaaaaggtgtaaaagttgttgaagaagatggcagacttataatagatatttacgttattgttgaatttggcgtgaaaattgttacggttgcagaaaatcttattgataccgtaaaatataatgttgaaaaacaaacgggactaaaaatcaaaaaaatcaatgttcacgttcaaagcgttagagctaatcaataaaataacggtgaggtaaaagtaaaaaatgatagattcaaaaatgtttaaaaaagtattaaaaggagcatatgctaacctagaaaataataaacaaatggttaacaatttaaatgttttccctgttcctgacggtgatacaggaacaaatatgtctttaacggttaaaactgccgttgaagaaatgagtaaggttacatctgataaaatcggtgatattgctgcaagcatgtcaagcggagctttaatgggagcaagaggaaactcaggtgttattttatcacaacttttcagagggtttgcaaaaggtttaaaagatgtaaaggaaattgacattgactctttaataggagcatttgagctttctacaaaaatggcttacagagccgttatgaaaccaactgaaggaacaattcttacagttgcaagagaaatgtatgaatttgcaaaagaacatggaaaaagctattcttcagtagaagattttatttctcacgttcttgaagcaggggaaaaatctcttcaaaatacaccaaatcttttacctgtattaaaagaagcaggggttgttgatgccggaggtagaggtttactttgcttatttgaaggtgctttaaaagttttaaaaggtgaagaagttgtatttattgatgttgaagatgtagaaaaagaagaaagcggagtacaaggctttgaaatagattcttctgatattaaatttggatactgtactgaatttttaattaaagttcatgaagaaaatttaaaatatgaaagtgctattactgcagcattaaaagataaacttactccaatcggagattctttggttgctgttcatgataatggaattattaaaattcatgttcatacaaatgtaccttggaatgcaatgaaaatggcggctacttgtggtgaactttcaaaaattaaaattgaaaatatgagagaacaacacagtgagcttattttgaaagaagctgaagaagaaaaaccggaagaaaaatattctaaagaagaaaaagacttcatctttattggtgttgctgccggaagcggtatgagtaaaatccttaaagatcttggtatggactatgttattgaaggaggacaaacaatgaatccttcaactcaagacttcttagatataattgaaaatacaaatggtaaaaattatatattaatgccaaataataaaaatatcataatggctgcaagtcaagctaaagaaataagcgaaaagaatattgaagttgtaaaaacaagaacaattccggaagctatttctgctttaatggtatttgatgcaacatcttctttggctgataatgccgaaaatatgacggatgcaataggcgaagttaaaacaggtcaagtaacatttgccgtaagagatacacaaattggtgatactgtaatttcagaaggagatattcttggtattttaggttctgatattgtttgtgatacaaaagatgtttcaactgcaacagttgagttgattgataaaatggttgatgaaggcagcgaacttattagtatttactatggtgaagatataaaagaagaagatgcaaataaagttgctgaaatagttgaagaaaaatacgaagatttagatgttgaaataacatacggcggacagccattatattactatattgtaagtgttgaataatatgagttataaattaacaaaccttaaaggtgtaggggaaaagaaagccttagaacttaataatttaggaattttttccctaaaagaacttattgattactatccaagaacttatgaggttatcggagatattaaatctataaaagatgcaaaacaaaatgggaaagaacttattaaatgtacttttgtagaagctcaaaaaacgaggatagtaagaagaaatttaaaaataacaaaaataaaatttgaaagtgaaggtagtatattttatgctaccttctttaataatccctatatttcttcattctttaaaaaagatgaagaatataaactttatggtaaagtggaaaaaaaggggaattattatgaaatggtttctccaaagtatgcaaagttaaatgatgaaacatctataaaaatcggacttaatccggtttacccgttaagcagtaaaagcaaaataacaaataaagagcttaagaaatttgctttaaatgcattagatattatgacaataaaggattttattccggaaaatataaaagatgagtataatttatgttcattatatgatgcatataaaggaattcataatccaaagatgctggatgatactcttaaagccaatgaacgtttgacttttgatgagttttgcggatttaatttatctatgatattgaataaaaacttaaacatgggagttaagggtgaaataatagaagtaaattacaaacaagatttcttagataaacttccttttacacttactaattctcaaaataaagttattaaagacatagaagatgattttatatctggaattaagatgaataggcttgttcaaggggatgtagggagtggtaaaacagttatagccatgtacggtgtatttttagctgttatgagcggatatcaagcagttttttgtgcccctacgaagatacttgcttctcagcattttgagaaaatgaaagaaatatttgataattttaatataagaatggaatttctttattccggtatgacagctaaagaaaagcgtttggcttatgagagaatagaaagcggaataagcaatgtgattgtaggtactcatgcagttttttcaaagaaagtaaaatacaagaatttggctcttgctgttattgacgagcagcataggtttggggttatgcaaagagggtttttaacaaaaaaaggggatagcgttcatactcttgtaatgagtgcaacacctattccaagaacattggctcttagtatttacaaagaccttgatgtgagtataatagataaaaaaccttccggcagaaaagaaataaaaacatactttaaagattattcatattatgacagagtatatagatttgctgtaaaacagattagtgaagggaatcaggtatatgttgtttgtccgtcaattgacagtgaagacttaaaagctgcagaagatatttatgaaaaattaaataaaacgtattttaagaatattaacactgctttaattcacggaaaaatgccagaagatgaaaaagacagaataatggatgatttttatggcggaaaaataaaagcgttggtttctactagtgtaatagaagtaggtatagacagtaaagacgcaactcttatcattatagaagatgcggacagatttggtcttgcttctcttcatcagctaaggggaagagttggaagaaatgacaaagaaagttattgtatacttttaagtaataatcaaagtaaaaagagtattgaaaggctgagttttttatcaaagaatacagatgggtttaaaatagctctttatgatttgaaaacaagaggaagcggagatattcttggagtaagacaaagcgggaaagacggatataatatatataaacttattgaaaacagcgagctttttaataaggcaaaagatgcaatggaagatattttaaacgacaatacaaaggaaaacagagattatttaaaatatataaaagaaaaatacagcagtatttcaaagaatattacatggaattagaggaaaaataaatgagagttatcggtgggaaaatgagaggaacgaatcttgatagtccaaaagacagaagagttcgtcctacaacagatagaataaaggaagatttatttaatattcttatgccgtatatacctgaaagtaaatttttggatttatttggcggtagtggtgcaataggtatagaagctataagccgtggtgcagataaaagttattttatagataataacatggacagtataaggcttataagaaaaaatataaagaaaacgagatgtgaagagttttgtaaagtaataaagaaagatgccttaagttttgttaataatacggaagaaaaattcgacgttatttttcttgatcctccatataaatatgaaaaacttaaaattttaatagaaaatatagtgaaatgtgatatactatgtaatgatggtatattagttgtagagcatgacaaaaatataccaattggagaatttgaacatttaacaaaaatcagatcaaagtcttattcacttacaagtatcgatttttttgttttggaggattagatgaaaaaagcaatatatgcgggaagttttgacccaataacaaacggacatttagacataataaaaagaggggcaaaggttttcgataaaatttacgttgtacttatggaaaacacaaaaaaaactcatctgttctcattggaagaaagattatcgttacttaaagaaagcgtaaaagaacttggtgataaagtcgaagtagatttttacactggacttatagcggattattgcaatataaaagatacttatattttaatcagagggcttagagcattaactgattttgaatatgaatttcaaatggctactataaacagaaagcttaataaggaagttgaaagcgtcttttttgtggcaagcaataaatatacctatgtttcttccagcaatgtaaaacaaattgctgaatttagaggagatgtttcttctatagtacctgaatgtgtaaacaatgcacttatagaaaaatataagggagagaaataatgaaagttttagaattattggataaattacaagatttagtggaaaatggggcaacagttcctttttcaacaaaaataattgttgaccctgacgaagttttagatttgttggatgaaataagagcagaaatgcccggagatttaaaagacgcaatcagaattactgaacaagaaaaaatgattgttgacggggctcaaagagaagcaaataagattatgaatgcagctgaaagaaaagttaaagagcttattgattctgatgaaattacaagaagtgcatataataaagctcaagatatgctaaaaaaagcaaatacagaatctttaaatatgagaataggttcaattgaatattctgctgcaatgcttaaagatttacaagataagttaagagaaatgatgaatacaatcgaagataataaaatagagttaaaagaacttagaaaatctgcaataaacagcagaccgccggaagttaacgaagaaaaataaaaagagatatttttatatctctttttttaatatcaccgctgaaactgtaattataaaagtatatattacacaaaagaaaaaaactgatgtaatactatatgaaaaaggtaaaaaattgcttagggcaaatgtagttatttcgcctcttaaaaatatgaaacttaatatataagaaataatagccgatatgcttccaataattatttttgaaatgatatattttaatgcgtttaaatctgtatttacaataaaagatatacattgcatatttgcacataatcccccaaatgataaaaggaatgtaattgatgaaattattattggtagagggagaatattaatggagcttaataatttaattccgtttgtcatttcaattagcccctttataaaagcggataaaaatatatgtaacttaaatggaagatattcattaaataaaatagtattgtcaattaaatttattacaagagaaaaaaacattatatatcccattacgcttaaaagagtatttagtgaattagtaatactgtcggaaaaaattttccctatattataatgttttttataatttgaatgtgaaatatttatttttgtttctttatcatatttaaaaaatattttagcgtatataaataaagccgagtatatgcttattaacattataattgcactaactggtaaatttaaaaagatactacacaccgtgcctattacaaagattggcccaggggtagagcatattgatattagtttagaggcttgttgttttgtaagtttattattaagatacatatcacaaacagatttgcttcctattggatatccgcaaatgatacttgtaattaaaggataagctcctattccacttgttctaaaaaatttagtcataaaaggggaaaatatttttgccatatattttgcataatcaagtttgaaaaacatatttgaaataactaaaaaaggaaataatgagggcagtactccgttaaaaaagagtattgccccgtcttttattgcacttactgcattttttgtatttaaaattaaatataataataaaataattaaaataataaaatataaaattctttgttttttcatattttatttatatgctatctatcaagataaaatgcctgcttgtaaaaatccagattgaatttatctaaattaatattatatatattgtctgccttaatatttttttcaattatttctctgtctgtttcatttagtttatatatatctttgtttagattattaaatatctgaattccgttttgttttatctcttttaaaagagttcttcctttgttatcaaaggcaagaactttgatataaccaggagtatgatgtttatatttatcaaattcttctttttgataatttgtaagaatatgaattaaaattcttcttattctgttttttgtatatcttttggtagatattatatttataaaattttcaacatcatttgaatgaaaaatattattgtatattctgttgtttagtcctatttctacgtcagcatagttatataagtcatctttgtccattgacataattatgctttttaaagtaaagaaataatcttccaatgtcttaacatgtggaatattattataagtttttattgcattaattggaacatagtcgcttatgtcttcaccttttagaattttttcccttataccgtaagcacttaaaaaactgtctaaactatctgtgcttttataagaagaggttcttttaattggataaggaattattaatgaattaagacttataagttctttaatatattctaatgccaatatattattgggctgttttataaaagaaatatctttatttaaaagtttatttaatgcttcttgctttgattcaatataagattttccttttgataaattatcttttaatatttctttaaagacatcgctttctttaagtaaaatctttgcaatttgaattgtttctctaagttttgagttgtcttccattccaaaacaaagataatttattattccgaggctgtttaatattcttactgcagaggaagcaaaaatttctgccgttgtgcaagcataaacaaaaggcagctctataacaagattagcaccgttttttactgccatttcagcttttttgtatttatcgatgatggataattctcctctttgggtgaagtttccactcattatacaaactacgttgtcggcattaagattttcttttattttttctatttgatatttatgtccgttatgaaacgggttgtattcagctattattcctgctgttttcattttatacctctgtgattatgtttttacttaaaaagtatagataactatgagagacttttttattcattaatgtagttattgcctttttataataatttatttgaagtttatattctttaataagcgtttctttttctttatctgttttaaaatagttggttttataatcaactaaaatcatatttccattttcatcttcaaatgtaaggtcaataattccttgaactaatacatcttcatcgctttctacccatttgtcagaaatatcttttgcaggtattgcaaggttaaaaggaagttccctatatattttttttgagtttaataattgtttgcctatttcactttcaaaaaaattatatacatattcaatatcaatgctttcatattcttttttagaaagtatttcttcttctattaatttattaatttgattatcaatattatctcgcaaattattatcttcttttaatttatttatatcaattgtttcaaaaatgaagtgaataattgttcctttttgtgctgccgatatttctgtttcttcttttaggaaatcaggttcttcttttattgtaattacattatttccaacttctaaaagttctgtgttttttaaactgcttacacctgcttttcttggaattttagtatctataatatttttatacttataatttagattttgaattattaacttactaaaatcttcatttataaatttttcattttttgttgttttatcttcgttattattagtgtccgttaataaactgtttatatcattgttatatattataaagtttttatcttcaaaaacaatattttctttcgtattaaaatgtttattacaaaggattgctttaactatccagtctaaatatgttttagcattttttatatctaatcttgttatttctttaggtattttttctaagatatcttcaattttagcctttgatgttattattaatttttcctttgctcttgtaagggcaacataaagtaaacgcatttcttcactttttagttcttgtttttcaagttcatttgcggcaatttttgaaatactgtttatttttattttattgtccaaatctattaggctagggcaaagtcccaaatctttatttagaacgatattttcttttaggtctctttcattaaaagtcttgcttgtatccattaaaataactattggaaattcaagtcctttgcttgcatggattgtagtgaattttacactgttatcactattttcatttaaggctatacctgactcatttctttcttttgcatagtccataaatttaataaatccatataaaccttcatttgaaaagttttcgtattcttttgctttggtaataagtgctttaaggttattttctctgatattaccaaagggaagagcttttacatattctgtaaaagaagtcttttcataaatatcttcaattaaatcactgacagacatatatagacttttagagttatattcgtttattatatttatcatatttattactttatttttaagttctatattgtcattttcttctttagtgaaattttcaacgcatttataataatatttttcttttgagtataattttatttccagtagttcctctgtggaaaaattaaaaataggacctctcataactccaagtagtgacaagtcgtctttaaaattatttattatatttaagaagtctttaattattgatatttcgtgtgttttgaaatattccgtttctttttcgctgtttacgggaattgaatatttgttaaatatttcttttaacggttttatttttgtattggcacttcttgcaagaatacaaatatcagaaaattttgtttttctgaatttcttaagttcactatcatatatatcttgctttattaaattgtttattaacattgccaggtatgtatactctttttcgtcatttgttaaaggtttatcaaaataatcttcatcattttcattttcttttaaaaagtgaagttctattttactttctatttcttcatttcttcccgggataagcttttcattttcgttatagtctattttacctatctcttttgacattatttttgaaaataattcgttgattcctgatatgatatttttatttgttctaaaatttgtattcatatatattatttcgtttatatcattttctttttcatatctttctaaacgatttatgaatacttcaggttctgcttgtctaaaacggtatatactttgttttacatcaccaacagtaaaaagattattttctttaattatttttgttatgattgcttcttgtacaaggttagtatcctggtattcgtctacaaaaacgaaatcaaacttgtttacaatttcttttcttgcattttcattgttaagtatttcaaggcagagatgttcaatatcattaaattccaaaacacctttttccttttttatttctttatagtaataatcaaaatcaatcaaagctttttcgattgtctgcatttgaggataaagattattgttgatttttaatatatcttcaatagaaaaagcatataaattatttatgatattttttattgtatcttttgctaaattccttttttgtgttatttcattttttatttggggatcgagtttgtttgttcctacaattcttgctctaaatatatcacccatttttaagctgaaaactttgttggaattaccttcaaaatctctttttaaaagttttatattgttaacttcttcatttaataagtctattaatttttcatttgctttgtaaaattttgctttttccaaggcttcatttagtagattaaaagaaagttcaattccgtcataagcttcttctttaattattttaaaggcaagactttctttaagctcttcttcgttttgattgaaaaattctactttttcatgaagccatttaaaaggagatggtctattgtatataaaagtatatatgctttttaattgttccttaaaatagtcttcatttgtacgtgaaaaagaataatttaatgatgtttgaatgaactgttcatcattattttcatatctatcattaaacagtttttcaaaagcttcatccataagcatgtctacatttgtatccgttattatttgaaaagatgggtctatttctacaatatggtaatattctcttataatatttatacatagagaatgaagggtactgatatttgcactttctaaatttgaaatttgttcaaataaaaactttttatcgcttttttcttcttttaatttttcataaagaagctttcttattttctctttcattccgtttgcagcagcattggtaaaagttactacaagaaatttattaatgtcgattttattttcaagcattaatcttattattctgtttgttaaaattgcagttttaccacagcctgcccctgcgcttacaaggaggttttttccgtcgttatttattgctttatattgactttcagtccatttcattttcactttcctcctttataagttttaatatgtcttctgcttttgcttttggtagttcattaaatttattatctttaaagcaagtatcaaaatgacatatgttttcatatttacaatactcgcatggtgtttcacttgcttttttatatggagttattgatattttaccatttataatattatcggaaatttcttttgctaaattcgtagcatgatttattaagtttgataaatcttcttttggaataactttatttcttttgcttttaagtttctttactattccgttgttttcatcatcgtcaatattatttaatatatccgtattatcaataacaactccgtcaatttggttttcttctgctttatctattaatgtttttaaatcctctgaattttttacgtttgttatttcaggtgagattctaaaatataatgcaccggcaggttcgctattattatttaatgttgttgctgcaaggtatattggaagctgcatatttattccataataactctttgagaaatcgaatgtttctccttttgttttatagtctattacctttacatattctccctcatcagccttatatgtgtctattctgtctattttccctttaatgtttacaatgttgttttcttttgttataaagtttagagagttttctttatcttctccgaattcactttcgcattttgaaatgtgaaaattgcttcttcttaactgtgtaactatatttgaaagggcataggaagaatttctaagaagtttcttcttaaaataagcgctgtttacaatttgttttactttcccttttgaatatttttctgttacttctttagttatttcttttgttaaatcattaagttcttttgaagtaattttgtttacgtcaacttcattatttattattttatttgagaaaatgtatataatctcatgtaagatatttcctatatccgggctgtttaattcaagtttttttcgttcaattggggagattatatatgaaataaaataactgaaaggacattttgcataagtttcaagctggcttatgctggttatcattttgccgttatatatttcattaataagtttcttattagaaatttctgagttgttgctaaagtttatagcgctttccattatgtcaatataattttttcccaagttatcatttttataaatatcataaacttcttcccaaagattattcacttcgttgttttcgcttttattaattttattatttattaaatgtttaaatgtagcatcaaaatttgatattaaacttaaattatcatctaaattatctttattaaaagtttttgttctaatgtttggcataatgttttttattcgcattataatagaactttcggtcaattcatcaccggaaggagaaagtataggataagaaaaataaatgtgtttttgtgtttttaaaatcaacgatgtcaaaaagtatttttcttcctgttgtttgtattcatttgtacttcttatttctactccgctttctataatttgaagtttttccttgttagaaaaaatacctcctgattgggcaaagtttgttgggagtatgccgtcatttacacctagaataaaaagatattttatgtcgctgcttctggaacgtgataaagtagcgatatttacgctgtctatggttgatgggattatacctatttttaatgctttaaatccgctttccattatttttgcatattcttttaagcttagtttttcttctccaaggaagttataaagctgttcaaatatatttattatgctgttataaatttgtgcgtatttatttgcatttgtatagtcatctttttcttcaaagttttttactattctttttattttttcatctaatccaaaatcttttaagaatttataaaatacagtagttgtttcttttacatttttagtatttttaaagttttcttttaaagcaataaggggtaaaataaatgcatcttttttctcattcaaataatctaaattatagtcattggatttattatttcttttaaagtctttaagccacattgtgccttttatgccaaattccaaagcataattttcaaaggtttcgatgtcgtcttttgataaatctgtaagccctgtttttaaaaaagaaattatatcgttcgtttggaagttactgcttattatatttaatatttttattattcctcttaatatatttgtgtctattacatttgatgtattgtctaagaagtaatttattttatatttattgaaaacttcacttatgacatttttatatgtttcgtaatctgaaggcaaaacttgtatgtctctatataaagcattttcctcttttataagctttaagatatttattgctgtattttcaacttcttcgtatatacttgaggctttaaaaatttcaatattttttacctcatctttatattcctttgtgtcatatgaaaaaatattatccgcaaggaattttaaatctttttctttttcttcttcgttttgtgtttgaatattaaattcttcactacatttatctgcaagtttatgtaatttatatattgtattttctactattttataagcaggggagctttttatatcatcttttgcggtaaataaaaaagtttgattaatttcccttttgcttatagcttctataagagaataaatgtttttatcgaaagactcaaaaccaaagtagtaaatttcgctgttatccaaaaatcttgctttatctaaatgttggcttgcatgaaatgttaaatcgtcagagtcccaaaaatcagtgcctaaaaagttattatatctttcatagattttatgaatatcatgagtctttttatataggaaattattcttattttcttcatctgaaaatttatccgggtttaaatcttcaccggttacattgtttttcttgagttcagaaaaaagttcacatacattttcgttaaaagatgcattatttgtaagtcggttaaagcatataagttcttcttttaattcatttaaaataaagctaagaaccatgcttttcccgctttcgtctaaggtttttggcacttcgctttttgtttttgtaagtattctgtttgaaagtcttttaatgcttaaaacttcaatatcaataagcccttttgccgttaatttgtctgtaagcattctttctgcttctactgtaaattgctccggaactaaaaagagaattttatttatttcattattctcttttaaagttctcttaatatctctgctggctttgaaaaaggctttttcttcaatgtaactggttattatattaatcattttctttattaatcatcctcaaataattttattttttcaagtttgtctatgtttatttttaatctttttatatatgaaacgaattctaaaatatccgctgttgtatagagtgatttatagctttcttttgtattacttaaaaaatcatagtcttctaaatatttttttacatttcttaccatttgttccgcagggtctaaaagagtaaggtttttatatatttcgtttatttcaccttctattatagggaagtgagaacaaccaagaattaattttgatacatcgttgttttgatctataattggttgtatacattcttttataagttcattaagtaagggtttattttcgatttgcgagtctattacctttggaagtcttgttgagtcgtttgatataattttaatatttttatttactttatgaatttctttattatatgatccgctttctacagtagcttttgttgcaataagcccgattaaattatcattttcttcttcgcatttttttagggcatattcacttcctgctttaacgatactaaataaaggtacatttgaattaagacttttaatatgagatgaaatagtattgcaggcaagtaaaacagcttttacatgatgtttttcaagaaaagctatcattgcgtttgcatatttaattatgtcttctttgcttttatttccataaggcattctttttgtatcgcctatgtaaattatattttcgttaggtaggagtttttctgtttgtctaaaaactgtaagtcctcccactccactgtctaaaatacctattggtagattattactcattaaaattgacctctttttataataaatttgaattactgtgattattctatcataaaaaacataacattaaaacaagataattgaaggagaagcctatgaagttatgttatatgatggatattggtagatatgaggaaaaatttccttgttctaagtggaataatctgtatgaaaggttgtatcaaatgattttcaaacaaaggagagtaaaaggtccatttttaattaaagacggttcctttaaagttgtggggagtgttttcttggtggattttaataattttatatcaaataggaatttaaaattaataaataattattttgatgataatgaagaggggtttgtatgtttcccgagagattttaatgtaaaaaatctttcaatatataatattccatatattcatgatgaagatatatattttattgctttctttttaaaattaaaaaaaatggtaaaagatgcacaaaaaacacaggttggagtttgtttggataaaaatacaaattatgaatatataaagatgatttgtgaatattttccacttgtaatattttttgttaataatccttatattggggaaaatattgcaagtaatattctaaaagatactggaagcagtatatatgtaagtaaaagtatatcttcaatgaaaaaatgcgactatatatttgatttaagtaaagagatgttaagcgataaaataaattatatagaatgtgaaaattatatttcattatacaaaaagaatgaatatatggattgtgaaaagataattaacgatgtaaaaattattccaagcggttttaatattcaaaatatagatattgattattttgatttatcctttgtaaaaggtcttatattattagaaaataatgcaaacgacaaaaaagatatattaaatattaatttagaggaatttttacataaaaaatctttaaaaatgcggttttttaatgggtttaagctcttgacatgattaatttgagttattataataagtccattagtataaattgaaaaatataattaagaggtaattttgatgactggtaaagaagtaatcttatcaaaagaaggatataaagaattagaagaaagattaaattacttaaaggacgaaaaaagacatgaagttgctttgaaaatcaaagcagccagagaattcggcgatttaagtgaaaatgctgaatatgatgaagcaaaacaagaacaaggatttattgaaggcgaaataagagaaattgaatataaattaaaacatgcgttaatttttgatgatgaaacaaaaacaaaagatattgtttctcttggaagcaaagtaaaagtttatgatactgattttgatgaagaagtagaatatattattgtaggaagtgaagaagtagacttagacaacaataagatttcaaatgaatctcctattggaaatgctcttttaggtaaaaaagttggagaagtagcaaaggttaaacttcctgatggaatagttgatttaaaagttttagaagtagaataagaatggagagatgataaatgagtagtgatttttatgaaaatgttcctgaagtagttaaagtaaagattgataaatttaaagaacttacagctcaaggaaaatatccttataaagaatgtagatttgaatataatgcattttgtaaagatattaatgaaaagtttgaagaatacgacggcaaggaagtaaaaattgcaggtcgtcttatgtcaaaaagaggacaaggtaaggttggtttttatgatttaatggattcaactgataaaattcaacttttcataaaaaaagatgttgttggcgaagaagaatatgctttaattaaatcttacgatatcggggatattcttggaatagacggagaagtatttaaaactcaaagaggtcaaatttctgttagagttaaaaaggtaacaatgcttagtaaatctattcaagttttacctgaaaaattccacggacttaaagaccctgagcttagatatagacaaagatatgttgatttaataatgaaccctgaagtaaaagatgttttcttaatgcgttcaaaaatcgtaaaatgcatgagagattttatggatggagaaggttttattgaagttgaaactcctgttctcggaacgcttgcgggaggtgcaaatgcaagaccgtttattactcatcataatactttggatattccaatgtatatgagaattgctacggaacttcctttaaaaagacttattgttggcggatttaacagagtatacgaaattggaagaatttttagaaacgaaggcatggatgctactcataatccagaatttaccactatggaatcatatcaatcatatgcagattttaacgatgtaatggaaatgattgaaaagatgtacgattatattgccacacataccgtaggaagcaatacaataacatacggagagcatgaaatttccttaaaggcaccttttagaagagttaaaatggttgatctcgtaacagaagcaacaggtgttgattttgataaaataacagatattgaagtggcaagagcagaagcaaaaaaactaaatgtagaacctgaacctgactggggtataggtaaaattatagaagagttgtttgaagaacattgtgaagcaaacttaattcaacctacatttgtaacacatcacccggtcgaaatttctccacttgctaaaaaatgtcttgatgatgaaagatatactcaaagatttgaattatttgttgcaggtcacgaatatgcaaacggatttagtgaacttaacgacccatttgatcaaagagaaagatttgcagcacaaatggaaaagaaagcaacaggggatgaagaagctcacccatacgatacagactttatcaatgctcttgaagttggacttcctccaacaggcggtgtaggtgttggtgtagacagacttgtaatgcttcttacaaatcaaagttcaataagagatgtaatcttattcccgacaatgaaaccacttgacagtgtaaatactaaagttagtgaatctaatgtagaagtaaaagaagaggataaaaagattgatttttcaaatgtaaaaatcgaacctctttttgaagaaatggtagattttgaaacattctcaaaatctgatttccgtgctgtaaaaatcgaaaactgcgaagaagttccaaagagtaaaaagcttttaaaatttactcttaatgacggaacagaccgtaaacgtacaatcttaagcggtattcgagattattataagcctgaagaattaataggtaaaacagctattgcaatagtaaatcttccaccaagaaaaatgatggggattgattctgaaggtatgcttatatctgcagtacacgaagaagatggaaaagaaggattaaatctattaatggtagatgataaaatccctgcaggtgcaaaattatattaagatataaattaaataagtgggcagcttggtaatacaagctgtctatttttataatttaaaacggggagaaaaatgaaaataagaaagtatagaccttcagactgtgaagaagtaataaagttattttatgatacggttcataatataaataaaaaagattataccaaagaacagttagatgtatgggcgacgggaaaagaagatttagaaaagtggaatagttcattagagaaacattttactttggttgctactaataatggaatgattgtagggtttggagatatggatagaacgggatatcttgaccgcttgtatgttcattcaaagtatcaaggtgttgggattggaagttctatttgtgatttattagaaaaatatgtaaatgaaaaaattgtaactcattcctcaattacagcaaaaacattctttgaaaaaagagggtataaggttgtgaaaaaacaacaaataaacaggcagggaattattcttgttaattatgttatggaaaagtaattttatttataaattttatggggtcatatatttatatataatcaattttagcaacaaacagttgcttgttagaagattgtattaatattataatgcttttaaaggtggaggttattaatatggatacaaaagatattatttataaacttagaaaagaaaaaggaatgtctcaagaagaacttgcaaataaggtgtatgttacaagacaggcagtatctcgttgggaaatgggagaaactctgcctaatactgaaacactaaaattattatcaaatgtttttaatgtttcaattaatactcttttaggttctcctataaaactaatttgtcagtgctgtggtatgcctcttgatgattctataataagtaaagaaccaaatggtgaatttaacgaagagtattgtaaatggtgttataatgaaggggaatttacttatcataatattgatgagcttatcgatttttgtgtagagcatatgtacatagaaaactatactaaggaggaagttagggcttatatgattgatttgcttcctaaactaaattattggagagatatagataaataatattttagaaatagatgttttgtagttttaaatataaataatattattgttttagctttggtaaatttaccaaagcttttttataacataattgttaaacaatttgttataataaataaaatattagtattacttttctaataagaggtagtttgaatggcgtacaatgaacttgtaaaaaattttaatcgtattagagattatatgagagaattttatgtttatggatttaaaagccgcaaagagtatgataataaaagtgcaagatcttacgataatgaaaaaagaagaatagaaagctggcttggggaatatatgggctttaataaaacaaaagaaggaaaaaatgtttttatatccatagattctaggttagaacaacataatcctttatataaagcatggaaggcaaagagttttacaaatggagatattacacttcattttattttgtttgacatactatattctaaagatatttctatgtctataaaagagattatgaaagaaatagataatattcttattaattttgataatccgaaattttttgatgaatcaacggtaaggaaaaaattaaatgaatatgtttctcaagggataatagttaaagaaaagaaaggttcagctttatattatagccgttcaaaaaatactaagtttatgaacactgattgtttggattattattcggaaattgcaccttgcggagttattgggtcctatcttttggataaagttccaaaagataaaagcaagtttaattttaaacatcattacataaccaatactatggatagcgaaattatggaagaagttttttatgcaattagagaagaaagagaaattaaaattaaaacgataaatcaaagaaagaaagtaaaaaaggaaaatgaagttgttccattaaaaatatacataagcgtgcaaaacggaagagaatatttaatgtcatattctctgaaagataaagtaatatttccttgcaggatagataatattgtcagtgtgaaattgggaaataaaaataaactatttaaagaattaagaaaggaattagaggaaaacaaaaaatatatatggggtgtaagtacgggaaataaagacagtaacactctagaacatgttgaatttacaataaaatataatgatgatgaattttttattccaaagcgtttggaaagagaaaagagatgtggaaaaatcgaagaaataggtgataataaattaaaatttagcgcagatgtttatgatagtatggaacttgtgccatggataagaacttttatttgcagaatagaatatataagtttttcaaataaaaaaatagagaaacagtttaaagaggatatagaaaaaatgtatcaaatgtatgaaattgaggtaaaaaatgatttttagcgagttatatggtgtgtattattccacaatggcaaagattattgaaaaagccataaaaaatccattaaataaacaggatattgaaaagataattaaagaaaatgcttttgatgaaagtgttatgaatattataaaagcaatagaagaagagcagtggaacctaataaaaaaagacggtaccacgcctttaaaacataaacctactcttcctcttacaacacttcaaaaaatgtggttaaaatcaatatttttagactccagaataaagctgtttattgatgatattccaaaattagatgatattgaacctttatttttgaaggaagatatatatttttttgataggtatttggatgctgataattatgaagataaaaaatatataaagaattttagattgataatggatgcaatagaaaattcttatccattaaaaattaatatgaaaaataaaaaggataaagaggtaaatgttgtttttctccctaagagtctagaatactctaaaaaggatgataaatttagagttgtgggtataaataaaaaacatacaagcaggataaatttaggaagaataatttctttggagagatatgagggaaattttgatttttcaaaaagtgtggttatagaaaacgaagaatctcaaagatttgttgattttgaacttatagatgaaagaaatgcacttgagaggataatgttcaacttttcttattttaaaaaggaagtcgtaaagattgaggataaactctataaagtcagaatgttttatgataaaagtgatgaaacggaaatattaatagaaatactatcttttggaacaatgataaaagttactggtcctgatcattttattaatataataaaggatagattattaaaacaaaaaagttgcgatatttaatagttcgcaactttttttccatgatatgggaattttataatgctaaaataagcttgtagttaagatatttagaaataataaatataaaacttttaaagatacgcacagcaaagttgagattatgtatagctagttaagtagcacatacttcataggtatggtctgcccggtgaaagcccgagtgcgtaaaaagaacttgtatcttgtaaaaggcacttacagcaatgatggtttatatatagaaataagctcaaatttaagtgccttgtttcccattataaaaaaataagcaaaggaggtagtttttatgtgggcatatttaaaaagagaaaataaattaaataatacttttacagaaaatggagcaaaaacatatagtacaacaggctcttattgtttagatttattttcttctgttggtgcaattagaaataatagtgaaaatgatatagtgaatagatttattcgtgcattttatgaaaatgataatcttgcaatgaaactgctattctttgcaagggatataaggggaggtttaggagaaagaagagtttttcgtactattttaagatggcttgcttataataaacctgaaatagtagaaaagaatttaaaatatatagcagaatacggtcgctatgatgatttgttctgcttgatagatacacctgtacaagacgctatggcttgttatgtaaaaattcaattagataaagattatgaagctatgataaaaggggaaaatgtatctcttttggcaaaatggatgccttctattaatacttcaagtagagtagctgtaaaaaatggaaaattttttgcaaaatctttagggttaagttatgcaaattatagaaagagactttctaagcttcgtaattatatacatatagtcgaaaataatctaagacaaaaggattactcttttgattatgagaaacttccttcaagagcaatgtataaatacagacatgcatttattagaaatgaccgttcaaggtattttgcttatttaaacaatgtttctaaaggagaagctaaaattaatgtttctaatattatgccatatgaaatggtggaaccttatttacgtgagtggcaattatatttttcaaacaacaacgatgtaaaagaagaggataagatagcttttaatacaatgtgggaagcattgcctaattacgtaggtgatgaaaatacaatcgctgttgtggatacttccggttctatgtattatgatcaaaagccaatgccagcttcagttgcattgtccttgggattatactttgcacagcataataagggtatatttaaaggtaaatttattgagttttcaaaaaaacctgagcttatagatattaaaggggatactttctttgaacagtttagatatattgcttcatttaatgagattgcaaatactaatattgatgcagtatttgatttgattttaaatgcagctgttaaaaatcatattaagcaagaagaacttcctaagagacttattattatttccgatatggagtttgatatgtgtgttgaaggggctcaaatatcaaattttgaaagagcaaagaggaagtatgaatcttatggttataaacttccagagattgtattttggaatgttgccagcagatatgggcatcaagcggttagcgcaaatgaacagggggtaattcttgtatccggattttctccaaatatctttaagatggtagcagagggtagctgtgaaccttataactttatgatagatgttttaatgtcaaaaaggtatgaggatatttcagcgtagagggattatagaaaagacaactaaaattggttgtctttttttattaaataggttcctatatttttattaacaataaaatttgtgataaaataaatatatcattgagattaaaactaaaaggagcttaaaaatgataaaagttttatctgttgaaaatatgaggaaaagcgatgcttatacaatagaaaaatatatttcaagtaaggaacttatgtataaagcaggggtaggagtatttaaaagcgtaaaatggaaaggtagtgttgccgttgtatgcggcagtggcaataacgcaggagacggatatgttatagcaagtttattacatgaaaacaatattccttgtactatatttttaataaaagaaaagttttcagaagatgggaagttttattttgataaatgtgttgaagcagggataaaagtagaaatatgcagtgaggaaactacctttgaaaattatgatatgatagttgactgtatgcttggcacaggttttagaggagatgttagaggtttagcaggtatgattatccatgaaatcaataaaagcggtgcatatgttgtgtcagtggatataaatagtggtctaaacggagatagtggtatgagttcgttatgtgttgcatctgatttaactgtttccattgggggttataaattaggacactttttaaatatggcaaaagacgtaataaaaaataaagtgaactgtgatattggaataaaacctgttgatgaaccttattatttaattgaaaaaaacgatttaaaagaaatttttaaggaaagaaaaaattattcaaataaaggcagttatggatatattgcattaataggtggatgtaagaaatacagcggagcaataagacttgcgtgtatggctaatgcagctatgcgctcaggtgcaggcgttgtaaaaatagggttgcctgatagtataagctctgatgtaacatctcatattttagaaagcactctttatcctttgaaagataaaaacggagaaatagaatttgataaaaaagaaattgacggactcattaaaggagtaaagctcgttgcttttggaatgggggtagggttaagtgatgaaacttataaggtgttaaaatatattttagaaaattatgatggcaaacttgttattgatgcagacggattaactatgctttcaaagatggatgaaaatatatttgaaaaaacaaagtgtaaattaattctgactcctcatataaaagaattttcacgtttaaccggtcttaccatagatgaaatacttgaaaatccattgaaaatagcaatgaattatgcaagggaaaaaggtgtaattttgttattaaaaggacctagtactattataacaaatggtgaaaaagcatatataacagatagaggttgtgtaggaatggctactgcaggaagtggtgatgtgttatctggtataatttccgcagtgtgcgcatataatgatgatttattgctttctacagcaggcgcttcatatataaacggtagagccggagaattggcacaggaaaaaataaattctataagcatgattgctagcgatacagtaaataacattgccgaagcgataagtgaaataataaaataaaggtatataattctttaaaatgtaaataatgtaaactgtaagagtcaagtattaataataattgtaaaaaaaactgcaaaaaagtgtaaaaaaggtattgacagttaaggaataaagtgataatataacaaagctgtttcgagcggatagctggataagcatacgagaagaagtcaatgaaaaaaaatgacaaaaaatttattttgttagcttttttggagttataaggatataactatttaaattgattttataaatataaatagattaaattttctgaatttttacttatttatgtttcccatatagataaaatatgatataatgaattaattatacttaacttgtaagctgggggaggtttatatgttacaaaaagaagacaatactcaaaaaaaatatgcgtttatgaaagatactttaagtatgctatataaaaaatatggttatgaacaaataacaataccaatgtttatgccttatgatttatataaaaaatatgatattagtcatagcaatgaacaattaaaattaattgatggggaaggtaatattcttgtaataagacctgacgcaacttttcatgttttaaaaactgttgctaatatgaaaaataaagaaagcgaaaaatatttttacgaatcaaaagtatttagaaataaatttaaagattatactttagatgaaattaaccaaacaggagttgaatgtttcttaaaagaaagcgacttagtagatagtgacattatcgcacttgctcttaatagtgtttttgctcttggaattgaagatataagacttgatttatctcatgcagattttgtttatggacttatagaagaaatacatgaaataaaaaaagaagaggtagaaactgttcataaatacatagaacaaaaaaacagtgcagacttaataagctttttggacggaagaaatatagataaaaaatatctagataaacttattgatatatgtatgctttttggtgactttgaagatgtaatgaataaagcaagagacatagccgttaatgataaaatgaataatgctcttgataaaattgaaggcgtttatgaacttttaaaaattcatggtcttgataagtttgtttacttagatttaggttttacaaacgcaatgcattattacagcggaataatgtttaaggtttattctattgatgccggaggagaaatcattacagggggaaggtatgacagacttgcaaagaaattcgcaggtagacaaggtgcatgtggatttagtcaaaacttagatttaacttctcaaatacttaaagaagatacaaaattcttcggggtagattatatagttcattgtttggaaagcgatagtaaaaaaggtattgaagtttcaaataaattaagacaaaaaggctataatgtttcaatggtagcagataagagttttaaggttgtagcaaaagaaaataataaaaccttaaaagaaaatgaattattagatattttaggagagtaatatgataaaaatagcagttgcaaaaggaagagtagcaaaacaagccataaagttgtttaatgaattcggtattactttttccgaatttgatttgaatagaaaacttattttaaacagcgatgataacagtgtacaaatggttcttgtaaaaccaagtgatactcctatatatgtagaaagcggagtatgtgattgtggtattgtaggtaaggatatacttcttgaagataatcctgatgtatatagattgttccctttaaatattggaaaatgtaaaatgtgtgttgcaggatttaaaggtacagatgtaaagaatatgaagcaaattgttgctgcttcaaaatttgtaaatattgcaaaagaatattttgacaaacttggaataaaagcaaaaattataaaaataaacggttccgttgagcttgcaccccttcttaaaatgtcagatgtaatagttgatattgttgaaagcggggttactttaaaagaaaacggactatgtgtattagaagaaatttttgatatatattctgtttttatcgtaaataaagcaagtttaaaaatgaaacattcttcattaaaaccatttatagaaaacttaaaagcagcaaatgaaagaatggagtaaaaagatgaaaataatagatttaaaaaataaagaaaattatttagatatattaaaagaaattttacaaagacatggtaataagttaaacgaagtagaaaaaattgttgaaaatataattaatgacgtaaaagaaaataaagatgaagctttaaaaagaatgatgaaagactttgaccatgttgaagttaaaagtttaagagttgataaagaagaaataaaaaaagcatatgaaaatgcagatgaatattttattgaagtattaaaagaaagtaaagaaaatatagaaaaatatcataagaaccaaaaatattctcattttgatatggatgaaggaacaaaaagactaactcaaaaagttactcctatcgaaagagtgggattatatattccaggagggaaaagtccttatccttcaaccgttcttatgaattcgatacctgcaaaagttgctggagtaaaggaaattgcccttattactcctcctgataaagaaggaaaagtaaatcaaaatattcttgctgcggcttatgtttgcggagttgatgaaatttacttatcaggtggtgccggagcaatagcggctcttgcttatggaacagagagcataaaacccgtatataaaatttgtggtcctggaaacttatttgttgcagaagcaaaaagaaaagtttatggtgatgtagatatagatatgcttgccggaccaagcgaagttttagtgattgccgatgaaaatgcaaatcctgtttatgttgctgctgacttattatctcaagcagaacatgacgagaatgcggcttgtattttggttactacaagcgaaaaattggcaaaagaagttgaaaaagaagtatacagacaattaaaagaacttacaaaagaagatatagcttcaaaagctgttgaaaattacggaatgatattccttgttgaagatatagacaaagcctttgatgttgcgaatgaaatagcaccggaacatttggaaatatctcttgaaaatccttttgactatatagataaagtccaaaatgcaggaagtgtatttatgggtgaatatactcctgaacctgtgggagattattttgcaggctcaaaccacacaattcctacatcaggtaaagcaaagttttattccccattatcaacttatgattttatgaaaagaacaagtatagtttattattcaagagaagaacttatgaagcataaagataaaatcattgcatttgcaaacaaagaggggcttactgcccatgcaaaagctgttgaaaggagatttgaataatggatataagagagcttgttgttccagccttaaaagattatgaatgttacaaggctgcgggacaggattacagaataatattaaatgcaaatgagcattatgaaaattttcttggaacaaaacttcaaaatgattttattgaaaaaatgaaaaatatcaatataaatcgttatccggatcctgatgcaaaaaaattaagaaaagcatatgcagatttaataaatgttgatatggataaattgattgcaacttcaggctcagatgaaggtattactataatcagtgctacttttgtggataaagatgatgttgtaatgagttgtgatcctacgttttcaatgtatggtcaagcagctattttagcaaagggtaaatatataggaatagaaagtgataaagaagattttactcctgacattgatacattaataaaaagagcaaatgaagagaatgcaaaaataatttatatatgcacaccaaacaatccaacaggatatttgtattcaaaggatgacataaaaaaagttattgacaatacaagtgctatggttgtaatagatgaagcatatattcattttgcagaaggtgaaaaccttgatttgcttgattacagtaatagagtaataattttaagaaccttatccaaagcatttagcggtgcgggactaagagttgggtttataattgcaaataaagaagttattgatttcttatatgctgcaaaagctccatataatttatcagttacttctcaaacagcaggagaggttttggttgaaaaccataaatacatagaagatgaaatagaagttataaaggaacaaagagacaggatagtcgatgtactaaaagagtgtgaaggagtatttatatttccactaaacgcaaactttataacaataagaagtgataaggcatataaactttatgaagaatgcgaaaagaaaagcatatctataagggcatatggagagagcctaaaaaatatagtaagaataacagttggaagcaaagcagaaaacgatgaacttattgaagtaataaaggaggttttctaaatgagatcaagttatgaacatagaataacaaaagaaaccgacattgaaattaatttgaatttagacggaagtggtaatgtttatgctgatacgggggtaggtttttttaatcacatgattactcttttagcatctcattcaaaatttgatatagacattaaagcaaaaggtgattttgaagttgataatcatcataccgtagaagatataggtattgttttaggtaaatgctttaaagaagctgtaggggataaaagaggcattaacagatattcaacttttttcattcctatggatgaagttcttgcaagagtaagtgttgatgttagcggcagaggatatcttgtatatgaaaatccttttaatgttgaaagaataggggactttgaaactgaaatattagaagacttcttatatgcattttgcataaacggagggcttaatcttaatataaaaatattagacaaaggtaataatcatcatatgtgtgaagctatctttaaagctttagccagagctttaaaagaagctgttacaattacaagtgatgaaattccttcaagtaaaggtgtattatgataggtattatagattacggtgcaggaaatttaaagaatgtatacaatgctcttttaaggcttggatttgacagtgttattacaaatgacaaagacgttctttcgaaatgcgataaacttattattccaggcgttggagcttttggggatgggatggaaggtttagtagaaaatgacttgatagactttattaataattgggtagaggaaggtaagtatcttcttgggatttgtcttggaatgcagttattatttgaaaaaagttatgaaatgggagagcataaaggtctttgttatataaaaggagaaattgttccttttgatatacctaaagaatataaagttcctcatatgggatggaatgaacttgttattaatagagaagataacattgttaaaggcataaataacggagaatatgtttactttgttcattcttatcatgcagataagatgaatgatgaaaacttaattgcttacagtgaatatcattataaagttcctgcagtcgttagaaacggtaatgttataggtatgcaatttcatcctgaaaaaagcgataagacaggagaaaaattacttttaaactttttgggagaataaatatgataatttatccagcaatagatataagaaacagtaaatgtgtaagactttcacaaggagattatgacaaagagacagtttactttgacagtcctttgtcggttgcaaaagattttgaaaaaaaaggtgttaaatatcttcatgtagtcgatttggatgctgctttacttggtcagatgcaaaactatgatgttataaaaagcatcatagaaaatacaagtatgaaagttgaagtaggcggaggaatcagaggagaagaacaaataaaaaaatatgtggatatcggtgttgatagggtgtccataggaacaaaggctgttaaggattttgattttttgaaggaaatggcagataaatacccatataaaatcagtctttcattagatgttaaagatgaatatgtatatataaaaggctggagtgaaaacagcggtattttaatatgggattaccttgaaaaaataaaagatttacctcttgtaagcattgtagttacggatataaaaaaagacggaatgctttcaggtccaagctttgagctttacaaaagattaagtgaagctacaaaacataatattgtcgtttcaggaggaatatcttctcttgaggatattaataaattaagagaaaacgatacttatgctgttattgtaggtaaggcattatatgaaaataaatttaaagtagaggatttggtatgttagcaaaaagaattataccttgtcttgatgttgatcacggcagagttgttaaaggtaaaaattttgcaaatataaaggatgttgatgatcctgttaaacttggaaaaaattattctaagcttggtgccgatgagcttgtgttttatgatataactgcatcaagcgatgaaagagatatctttattcatacagttgaaaatattgcaaaagaggtttctattccttttacaattggaggaggaataagaacggtagaagattttagaaaagttcttttagccggagcagataaggtaagcgtaaactcaagcgctgttgtgaatccaagcataataagtgacggagcaaaaaaatttggttcccagtgcgttgttttatctattgacgcaaagaggaatgaaaaaaacagttgggatgtttatgtaaaaggtggtagagaaaatactcatattgatgcaattgaatgggcaaaaaaaggtgaagaccttggagccggtgaaatttgtattaattccattgatactgacggtgtaaaagatgggtttgatcttgagttaatagaaaagctaaatgatgttttatctattcctattattgcatccggaggagcaggaaaaatggaacattttttggaagttttaaaatgcggagcagatgcggctcttgctgccagtgtattccattttggtgaaatagatataatggatttaaaaagatatttaaaagataatgatatagaaatgaggatataaaatggaatttaaagattttaaattggacgaaaacggacttttacccgttattgttcaaaattataagactaaaaaagttcttatgcttggttatatgaacgaacaggcttataatgatacattaaaaacaggaaaagttaatttttattcaagaagcagaaaaacacaatggttaaaaggagaaagcagtaagaattatttaaatgttgtaagtatcgcaagtgattgcgacaatgatactttgcttataaatgcaaatcctgacggaccaacttgtcatacaggaagtgaaagctgctttttcaatgatatagtaaaagctgataaagatgaaagtgcagaaatcttatttacaattcaagatacaataaatgaaagaaaagaaggaataaaaaatcttgaaaagatgcctacaaaatatgaaggttcttatactcagtatcttttaattgaaggtatagataagatttgtaaaaaaattggtgaagaaagtgcggaaactattgttgccgctaaaaacaataataaagaagaaattataggggaagcaagcgaccttatatatcatttgctggtgcttttaaatgacagagatgtaaacatagaagacatatttgctaagttaaattcaagacataaataatatattttatcaaacaaaggaggggtaaaatgagacataaaggaacagaaataaatttctctgatattacgcctgaaataaaaaaattaagtaagacatgtgaagataactgttttattgatcaagaactttataagatacataatgtaaacagagggcttagggataaaaacggtgttggtgttttaactgggcttacagaaatatctgatgtttgtggaagtaaaattgtagatggcaaaaaaacatcaatagacggatatttaagatacagaggtattcctatcgaatctttggttgacggatttattgaggataatagatttggttttgaagaagtaacatatttgcttcttactggaaagctgcctaaaaaagatgaacttaaatcatttgaggctcaaattgcaaaatatagaagtttaccgccttcttttgttagggatattataatgaaatctccaagtgttgatgttatgaacactatggcgagaagtgtattaacgctatatgcttatgatgaacatcctgatgatatttcaatcgataatgttcttagacaatgtattcatttaatatcaattttccctatgattgcagtatacggatatcaagcaagtatgcattataataacggagaaagtttattcattcattctccaaaaccagacctttcgactgcggaaaatattttacatatgcttcgtcctgacagcaaatatacaaagcttgaagcaaggattcttgatttggctttagttttacatgcagaacatgggggaggaaacaactcttcatttacaatgcacgtagtatcttcttcaggtacggatacatattcttccgttgctgcttctcttgcatctttaaaaggtccaaaacacggtggtgcaaacgtgaaagttgtgaatatgtttgaagaaattaaaagagctgttaaagactggaaagacgaagaagaagtttctcgttatttaaataagattttggataaagatgcttttgataaacaaggtttaatttatggtgtaggtcatggtatatactcttcttctgacccaagagcattgatatttaagtattttgttggaaaattatcggaagaaaaggggcttaaagaagaatttgaattatatgaattagtagaaaaattagcgcctgaaattatagcttcaagatttagaacatataaagacatttgtattaacatagacttttacagtggatttgtttataaaatgttaggcataccaaaggaactatttactcctttatttgctattgcaagaatttcaggttggtctgctcatagacttgaagaacttataaatgcaagtaagattataagacctgcatatatgaatgttcaagaaaaaagagagtatattcctattgatgaaagataaaagatgctttatgcatcttttttgtttttataatataacaaacttccaagaagtatcataaataaacctataacttgaattatggtgaatttttcacctaagaatattattcctgcaagagttgatattagaacggttatattattcataagcccaacacttattacgcttatgctttttactgcataattatttaaataaaatacaagtattgttgcaagcagggatagatatagtattccaaagataaaatctttaagaaaaattatttctaaaatatctattgtagggtttaggaaaaagaaaataaaaaacattattgtaaatgcaataaatccataaaaaatttggtaaattgatactgtatttatttctttaattttaagcttctttagttttccttggtagtaggctcttgaaaaaatagataaaataataagcatggttcctaaaaaagcaaactgagttttattgctatttgaagatgaaacacttgcaatgagcgtacctaaaacacatattcccataaacatactttcttttaagttaggtttttcttttaataaaaaataacttactataacatttgcaattggaataagggctataagaacacttacggttgttacggggcataacattacccctattgtttgaaaagaaaaatttattaccggattataaaaagacagtctaaataaatctttatttttaaaagacagatgtatttttatttttcttatataaaaaattaaaagcataaatataaatgcaataaaaaatctaatgcttaaaactaaaaaaacattattatgggataattttattaaatcttttataaagatatactgcattcccattattaaactcattattaaagttgcaatatatccttttttatcgctactcataatagtagtatatgtaaaaaaaattcaaatataaaaaaaacagagaataactctgttttagtcaagcatgctatatgcaattttatcaagttcttcgcttgttaaattttcgtttatatcaattttttgaaccaagtcataaaaggttccttttaaaaatttttttaaagtatatcctaaaaaaactttttttgttacatatatgtcatacttgtcattacttgctcttaattcgttaaaattacttttcatgtcatactcctatgttttattaaattatatgatataataaccaagtagaaaaatcaataatttaaaggtatttttatgagagaaaacttcagtgaaaatttaaataaaaaaataaaactacttcctcaaaatagtggcgtatatcttatgaaagatgagaatggtactattatttacgttggaaaagcaaaggttcttaaaaatagggtaacccaatattttagaaaaaattcaaatcatacacctaaagttcttaaaatggttgagaatattgctgattttgaatatattattacttccaacgaaatggaagcgttgattttagagtgtaacttaataaaaaaatacagaccttattataatattttaatgcgagatgataaaacatatccatatattaagcttacaacaaaagatgaatatccaaaattatttataacaagaaaatatgtaaatgacggaaataaatattttggaccatacgcaaatgcaacatatgcaaagaaaacagtaagtacaataaatgaactgtacccaattgcaatgtgcaagaaagaattaaagtatggcgttaaaaagggtaatgtatgtctaaattatcatatcggacaatgccttggagtttgtcagggaaatgttaataaagacttatataattcatatataaaagaaataacagatattctaaatggtaaaacaggtaaaataatatcaagtcttgaaagcaaaatgaatgcttacagcgaaaatttagactttgaaaatgccggtaaggtaagagataagatttttgcaataaaagggcttaaaagcgagcagaatgtctctaatgccacagcagacaacatggatatacttggtcttgcaatgggggaagatatggcttgcgtacaggtttatgccttaagggataaaaaaattgttggaagagagaattatattttaaaagggcaaaacgaaaaagatgcaggagaagttttgtctgcttttgtaaaacaattttatacaaatactccttttattcctcctcttatattggtagaaagggagtttgatgatattgaaaatatacaaaatcttcttagtgaattaaaaactacaaaagtccaaattaaagttcctataagaggagaaaagaaaaaattattaaaacttgctactgataatgcaaaattaaatcttgaaaatattgtaggcaaagaaaaacaaagaatacttatggaaaagaaagccgttgaagaaataaatgattacgctggaataataaaagaaggtaactttagatatgaagcatatgatatttcaaacacttccggagttgacagcgtcggtgttatggtagtgtttgacggagcaaaaaggaataataaagcttacagaaagtttagaataaaatcagtagaaggtccaaatgattacggaagcatggttgaagtagtattcagaagacttaacagagcaagaaaagaaatggaagaacaagatgaaaatgcaaggtttttacctcttcctgatattatatttgtagatggtggaatagggcatgtgaatgcaataaaaaatgttgtagatacgtttggatttaatattaaagttttagggcttggaaaaaacaacaaacataaattaaaggaagttgttaaagacagcgaagaagcaagaaacataaaagattttgaatatgcaaaaaaacttcttaatgatataagtgaagaggttcatagatatgctattgattatcataaaaacttaagaagtaaaagtttcttaaaaacgacattggaagaaattgagggaataggaaaagtaaaatgcagaaatttacttactcattttaaaaacttagaggaaataaagaatgcttcaatagaagagattatgaaagttgacgggatgaatgaagctttggcaaaaaaagttaaagattatttgaaaaatgattagggagagcgaatggataaaaatttttatttaaaactttatgaaccatataaaaaagatttagctaaaaaaagaaggcttaatattcttgataagatagtaacatattctgtatttatttcttttcctgtttttttgataataggatttcttatggggaaagattttgtattaaggattgttcttactacttttattccttttgttcttttaagtttttttagaaaactatttaactttaaaagaccatatgaagtttttaatattactcctgttttggataaggatactaaaggtaaatcttttccaagcaggcatgttttttctgcatttttaattggaacttcctgtttgtttgttaatgtttattatggtgttattgttttgattcttggtatttttcttatgtacataagagtggttggagccgtccatttttttagagatgtggtttgtggtatgattttgggtgtatctttcggaatattgtttatgatattttaaatgttattttttttagtgtcttttataaattcaataataaatgatgaaattgtaacagttattaccgataaaaaaattttttttattggaagataagaaaaagacaataacagtactgtaaggtccattatcaaataagcatatgatatttttatatttgtattttttgttattgtaagtgccaaagcatcatctccacctcctgctcctccttgtcttatgattaatcccgtccccactccaataaaaattcctcccaaaattgtaataataaacatattgtttaattttattattggagggaatgtttcccaaattttaaaaaatacacttaaactgattgtggatattaacgatactgcaataaattttttacctaaatatcttattgcaagtatgtagcaaaaagtatttaatattggagaaagaatatgttgaggaatgttcatatggtggtgtaatagtaatgttaatcctattatgcctccttctgttatgttatattgttggtgtatattataaattccgaatgaaataatcatagctcctaatataattattaaagtcatttttatttttttcattttaaaacctcctttattaacatgataaactctagtataatactaatgtcaatggtattttgattcggaggctcataaatgaaagaatattataaaataagcgagatatcaaagttatataatataggtgttgattctttaagatattatgaacgtttggggattttaaaaccacaaaggagtagaaataattatcgtatgtattctttaaaagatatgtatattttaaatataattaaagatttaagactattaaatttttctatgaagaggataaaagcatatattgataatttggatattgacaatacattaaaaatgttaaatgaagaatacagtgctatatcatgtgaaattgaacgattgaatgataagaaaaaattgattgaaagtagggttaaaaaattaaatgacttttataatttttcgtctgataaaattttaataaaagatttaaaaagcagatatttggttacgatttccgccaatatttcatctgatgaagaaatggatatagttgtaaaaaagcttcatagaaagcatgagaaaaaatttttggatttgggaaatcaaacgataggtgcgtttatatctttaaaagatactttgaaaaaaggaaaaattttatataattctgtatttttattgtcatgttctgatatttttaattatgattataaattattatcgggtaagtatttatccgtaacttacaaaggtagttataatcaacttatggagaaaataaacgatatgtataattacgcaaaaataaataaaatagatttggatggggaaccttttgaaatctatcatatcgataataggtatactattgatgaaaatgaatttgtaacagaaattcaatgtaaaatcaaataattattataatttgcattttatacattaatgattattcatgcaaccgcaagtttacataaaaactttaagttgcaaataaaagttggtagaaaaaatggtaatgctctattaatattattgcaaacaggaggtgaaaaaaatgaattttggaacaaatttacaaaacttaagaaaaaagcatgatttatcccaagagcaattagcagaaaaattggaagtttcaaggcaagctgtttcaaaatgggaaaatggttcttcttatcctgaaatggataaacttataatgttaagcgagttatttaatattgatattgatatgcttattaaaggaaatcttgatattgaaaataatgaagaaggcagagagttatatgagaaaatgtataataagtttactaagatgattactcttggagtagttcttattcttcttggtgttacctttgttgcttcttttgaagagacttatgctaacaatattaaagcttttcctgttatagttttattaactcttattgcaatatcagtttttttatttgtttattatggaataagctggggtaactttactgaagagcatccttattttgaagatttctatacaaaagatgagaaaagaagatttaataaactttttgcaggcatgatatcctttggtgtatttttaatacttcttggaatcattgttgttgtaattggagaagaggtcttacagttaggtgaggattatcctcctataattacagtatttttacttttggttacaattgccgttggaatatttgtttattttggaatgcaaaaagcaaagtacaatataagtgaatacaacaaagaatataataaagaaaatgaaagttatgaattaagtaaaaaagaaattttttcagataaaatacaagctataataatgcttattgctacaataatatttctgcttattggttttattttcggattatggcatccaggctgggttgttttcccaattggtggaatattatgtggaatagtttcaattatatttgatgaaaaataaaaaacgaggtttgacctcgttttttattttaaaaatccagaaatgattttttcttcagcttcttcttttgtaagtccaagactttgaagttttaaaatttggtctccggcgatttttccaatagctgcttcgtgtataagttctgcatctaagttagaagctacaagggctggagctgcggcaacttttccgtttccaacaagtattgcatcacattcagaatgtccgttgcattttgcttctccgttcattttagaagtaaattcttgataagaatttccctttgcaacagaacgtgatactaaatctgcagatgagttttcgccttttaatgttacatcaaaatcagttttggcaatttcatctccgtctgtcattattctttctcttacaagaagttttgcgccttcttcaactacgccacttgtttttcttattgagctgtctacgccttcaagttgtattgtgtccatttcaagtactgaatttttcttaaggtaaacatctgtaacaggatcaattctctttgttccttttcctttacctgttgcaatgtgtttttcttcatatactacatgagcattttcttcaaggaaaaatctatgtattccgttgtgtcttgcatcatgtccatcatctgtatgaactccgcatcccgcaatgatttttacatctgcattttcacccacaaaaaagtcgttatatacaaggtcatctacgttcccgtgagttacacaagctggaatgtatacattttcgccctttgtatttggttttatatgaatttcaagtcctggagcatcttttttagattctattttaatattttcacttgattgtctacctgcacacttaccgtcttctcttatattaaaagcaccttcaaattttccactgaatcctgaaactacttttaaaagttgttctgttgttttattcatttactgctgcctccttttctttagggcacatatttgctctttcttctttgaataatgttggtaaaatctcttttttatttcctttagctcttacttttccgtctgatattactactatttcgtctgctattgaaagtattctttcttgatgagaaataataagaagagttccttttgtatgttttcttaaaatttcaaaggtttcaacaagttttgcaaaactccaaaggtctattcctgcttcaggttcgtcaaaaatatatagttttgcatctcttgcaagaactcctgcaatttctattcttttgctttctcctcctgataaagaatcgtttaattctctatcaatatattcttctgcacataaaccgactttgcttagtaatgcacaggcttctccttcattaaggtctttccccgcagataatttaagaatatctcttacggttaatcctttaaattttacaggttgttggaaagcataggctattcctttttttgctcttgttgttatgtctaaatttgttatatcttcattatctaagaatattttaccgtctgttacattttttattcctgcaattaattttgcaagacttgttttaccgcctccgtttgggcctgtaacaacgataagtttaccgtcttctatatcaagattaatatcttttattatagattgaccatcttctgtatcccattttatatgttcaagttttaacattttattgcctccgtttttatatgaaaagatattttatttctatttcgttgatagtatatcataagtttttatttaaggaaagtatttcctactaatttactattctttttctttgtttactaaatatatgcctatgcaaaccaaaatcagtgatatgattccaagaatattaaatacgcttccttcttttagaagtatcgcagaaagaattactccgcatacagggtttaaaaatccataaacagcaactttcccaacaggattatatttaagaagtgtagcccataatgaataggcaactgctgaaataaaagccatataaattaatagaataataccgtttattgttatattatttatttttccgcctgtaaatataccgattaatatcattattataccgccgattacaaattggtaaccgcttaatataaccggtttttcatgttttgaatattcttttatcatgattgatgagaatgcataaaatacggcagaaagaaaaattaaaccttctccacttaatttcatgttaaagtcaaaactgcttccgtttaagtttataattacaactccaataaagcctattaaacacccaaatatttttgatggggtaagtttttcatgttttaaaataagtgcggggataaggattgcaagaaatacatttgatgcttctattattgatgcttttgttcccgttgtgtttgcaagtccaacataaaaacatacatattgcagtacggtttgtaccattgataattttaaaatagaagggtaggcttcttttttaggtataagaacttttttagaaagaatgcttccgataactattgcaagtatgcctgccattgtgaatctaagtcctgcaaaaagcatttgacttgcagtatcatttcctgctatgttgaataattcatatccaatttttattgcaggaaatgcactcccccaaaggatgcagcagattgatgccaaaaggcaaattattataggtttagttaatactgtttggtcgttttttttcattatatgtcctttcaagtaaaaaagccctttggggctttattttttcataagaaaattatataattctcttttgtttaaattattttcttttgcaagattttttattatgtcttttggattttctccgctttcaactcttttttgaaaaatttcttttgtttcttccatagaaagatttttcttttcttctttgttgccttcaacgacaacaacaaattctcctttgatattttcttcattttcaaaaatatcaataagatttataacttcgtctctgtaagttgtttcatgaatttttgttatttcttttgaaatggcaacctttctgtttcctaaaacattatttattgcttttaacaaatcttttaattcataaggggaagaatagaagataagcgttttatccaaatcctttaacgtttttagtttttcctcttttttattatatttcttttgaagaaatcctataaacaaaaactcttcactgttaaatcccgataatatcaaagctggtaagagtgcatttgctcccggaacaaccgtaaattttatattattttctataagctcttttacgagtatgcttcctgggtctgatataaggggagttcctgcgtcagaaataagcgcaattttcttttcttcattaatcaaggaaagaatataatctattctttccttttcattaaatttatggtaacttattaacttattttttatttcaaaatggttaagaagttttatggaatgccttgtatcttcacaaagaattacatccacttcttttaaaactttaaccgctctgaaagtcatatcttctaagtttcctattggggtggaaactatgtatactttatcattcataattaaaaatattgtcttcttactattgtatcttctctatcaggaccaacagaaactattccgataggtatttcgcaaagttcttcaactctgtttacatattttttagcattttcaggaagatcttcaaattttcttacttttgaaatatcttcattccagccttcaaattcttcataaacaggttcacattctgaaagaacgctaagttctgccgggaagtcagttataatttcatctttgtatttatatcctacacaaagtttgattttatccattcctgttaatgtatcaagttttgtgaatactatgcttgtaagagaattaattcttactgcatattttagaattacagcatcaagccatccgcatcttcttggtctgcctgttgttgttccgtattcatatcctttttctcttaagaaatctccgtcttcatcgaataactctgtagggaaaggtccttttcctactcttgttgtgtatgcttttgctataccgcatacatcatcaataaaagcaggtccaatacctgaaccgatacaagctcctgcagctgtaggatgtgaagatgtaacataaggatatgtaccaaagtctatatcaagaagtgttgcttgagcaccttcaaataatacttttttaccttttttaatgtaatcatatataataactgttgcatcatcaacatattttcttatgatatctgcacatttattgtattcttcaaaaatatcttcaaattttaaagcttctccgccgtatacttctacgatttctttatttacgctttcaagattaatttttaatttttcttcaaatagttttgtatctattaaatcacaaattcttataccgcttcttttgattttatctgtataagcaggtccgatacctctttttgtagtaccgatatcatttttgccaagggatttttcgataagttcatcaagtactctgtgataaggcataattacttgcgctcttttatcaataattaatttgtcaaatttaacaccttgttcttttaatgtgttcatttcttgtactaaccatgtagggtctactaccattcctgcgccgataattgatggtttgtcttgaataacacctgaaggaataacgtgtaatttatatgtaattccgtttgctataaccgtatgaccggcattgtttcctcctgaacttcttactacgatatcgcatctatctgtaaaataatctgttatttttccttttccttcgtcgccccattgagaaccgactactactaaatttcccatcattaatacctcctagtactttttcacgacacttaattgtaccttatttatattgttttatcaatagcaaaatccttaatttatcgactttttacataactttcatgaattttcagaattattttataagttgattttaaatatttttttattcttatgttataatcgagttataagtaaaaaagaggtgtgatatgaaaattacagtactaaacgaaaacatggtttacagaaaaaacataatcgccgaacatggactttctgtacttatagagcatgataataaaaaaatattaatggatgttggacagagtgatgtatttttaaaaaatgcacaggctttaaatatagatttgaatgatttggacgcagttattatatctcatggacattatgatcatggaggaggaataaaatatcttaaaaatttaagtaatattcctagtatttatataacaaagaatgctcttattcctaaatacagcataaataaaaagacaaataaatattattttaacgggataaatgaaagtgatttgaatttatttaagaataaattatattttacagatgaaaaggaagaaatctttaataatttttatttaataagtaacataccttatgttaacagttttgaaaataaaccaagtaaattttatttaaaaaagaataacaaaatgataatggatgaaatgaaagacgagcaggtttttgtgataagaacaaaaaacgggctttgtgtttttatggggtgtgctcatatgggggtagtgaatgcaatagaatatataaagaaattgtttaagggagaaaaaatatattctttatttgccggtatgcatcttataaatgctgatagtgtaagagtaaataaaacaatagaatatctaaaaaataataatatacaatatattatgccttgtcactgcagcggatatagagttgtttccaaaatagccgatgaatgcgaaaagaatttcattgaagtgcagtgtggcaaaacaatacagctataaaatttatagctgtttttttgtatcttttataaactttataatttcttttatattttcttcttttacataatctatgccatttttcgtaatatcaatattttcttctttttctggctttaacaattttggtgcaattttaataattgttttatgaataaaattaagttttgttaaatctattccaccttgaagatagaaaaaagggatatcaatattattgtttttaattaaattatttatgttatctttatcatcttttgaatatattccaacgcctgccaaacccttaatattaaaatttttccttgcttttttaaatccgcaaatttgacttgcacatatccatcctataaaaaaaatttcagcatttttatttaaaatatttaaagcttcatcaatatcataacactttaagcctgtttcttcttttatcatttgagcatatcgtagagaatgtccggaattacttttatatactattgtttctaccattttatttctccttaaagttatataactattttacactatttttttattaacttcaattttatttataaaaagttaaagttcattcctctcttttctcaaaaacgacactataaataagtatattaatactaaattaaagttaaaggacaagttatatgaatttaaatgaaataccaaaggaagtaactgatatattgccagaaaaaatgcttcaagtaattgagaaggttgaaacaaaaaatcaagttgaagaaataagaatcaggcttgataaaaatatacatatagtatgttcaaatgaggattttttaattttatataaagttacaaaaagcgatatagaaggaatattaaatcttgcaacggattattccttttacgcaaatgaagaaagtttattaaaagggtttattacattaaaaggcggacacagaataggttttagcggaagtgtaataaaagaaaatgacaaaataatttctataagaaatattaattccttgaatattaggattgcaagagagattgttggagtaagtaaccttgtaatgccatatatattaaataaagacaaaatactaaatactcttattgtttctcctccaaaagtaggaaaaacaacattgcttcgtgatatttccagggaaatatccacgaataaaaaaggatatataggtaaaagggtatgtattgtcgatgaaagaaaagagattgcagcactacataacggtataagccgcttaaatgtaggacagaagagtgatattttggaaggaattgataaggcgtatggaatgaatatgcttataagagcaatgtcaccacaagtgataataaccgatgaagtagggaagattgaggatatttcctctttggaaaattgtgttttaagcggagttaatgtgatttcttctgctcatggggaaagtatgcaagatatattaaataaaaaagagtttgtccccattattaaaaaaggtatttttgatagatatatttttcttgaaaataaaaatggaataagaaaattaaaagaaatatataacagaagtttagagaggttaatatgattgtttttaaaattacaggaatgttttttttgtttctatccagtgtgttttgttcaaaacagattacatcaaaaataaaaaagagagtttatgaacttgaagaaatagataatattttaaatgattttattgtaagtataaatgttggactttacgatgttagttttttactttcagaagctataaaaagaacaaagacaaaataccatgattttttatgtgaagtaaaagataatcttgataaaaaatcttcaaattatttttcaaagatttggtttgattgtttgaagcattatcactttgatattacattggaagaaaagatacttcttgaaaatatcggtgcaagtctttcctttaatgataaaaacagaatgataaagcagcttactttacttcagacttctattgaaaatcaaatacaaaaagcgagaaaagataaagatacaaaagtttcgttatatgaaaaaatgggagttttggtaggaggttttttagtgattatttttatataaggagagagtaaatgcagatagatattatttttaaaatagcaggtgtaggttttattgttgctgttttaagcataattttgaaaaaaagcgatagggatgatatggcaacaatggtcgctttagcgggaataatcgttgttttaatgcttattgtaaatatggtaaatgagttcttctctacggtaaaaactatgtttggattatattaatatggatattgtaaaaattgctattgttggaattcttggcagtatcataagtttgttttttataaaagattttaaagaatatgctttgtttgtttctgttattgcaggaataattatattaggttttgccgttaaatatttatatggtgttatagatgtaataaatacttattccgttaaagcaaatttggacatgcttaacataaaagcaatatttaaaataataggtatatcgtatatagggcagtttgcgtcggaactgtgtattgacagcggtaataaaatgcttggaacaaaggtaagcttttttacaaaaatacttatattgtatttttctcttccgctattaataagtttgttttcttatatcgaggaagtattatgaaaaaaatatgttttttgtttatatgtttttttattattgtctgccctgtaatagttattgctggggaagagggaaatagtgaagattacagctctttaatagatggaatatatgagcaaggacaaatttataaacttgatatgtatactaacgataatagcttctatgaactttttaattttaataatatccaaactttcataaaagatgttttaagcggaaattattcttttgattatgacaggtttataaataccataaaagatatgtttttttatacctttaaagaaagctcttctatacttttaacttttattgcactttctatatgtttaagtcttattaacttattaaattcttcattcatgaacaaagagataagcgatgttgcattctttggagtgtatctggttcttattatggttgttgttaaatgctttttcgatattgtaagtacagcttattctcttgttaaagcaataacaggttttatgaatgtgcttcttccaataataatagttttacttaatttgagcgggaatgttttttccggaaatataataagcgtaagtttagtatttataataaatttctttgcatcatctatgacatattttattattccagctttaagctttggttttatattaagcataatagataacattttaatagatataaatatttcttatttggtatcttttataaaacagatggtgttgtttttaatggggatattttcatgtttgtttttaggtattttaggtcttcaaggaagtttgttttcatctattgacagtctttcattaaagacagcaaaatttgcggtaagtaatctcgtccctgttcttggttctttaatttctgatagtacggacacggtgattgggtttataaaggttataaaaagttctgtaggaattgtaggtatacttatttttatatctttgcttattattccgcttattcatatgctttgtttggttgtaacttttaaaatatccgcttttttatcccagcctataacggatgcaagaataagtaaggctcttaatgatacagccggatttttaagtttgatttttgcttgttttatggttgtttctatattatttattatgcttattggcatcatctcaatgataggagggtaggatgaatgagtatttaaaaagttttatatatttaatgcttgttataagtattttaaggatgttatcaccagctaaagaatatgataaatacataaaattttttgtttcattactatttgtggtatcaattttatcgcctattatatctgtggtaaaaaagggggagttctcttcttttttaaataaaaattatgtaactatggatgagttggaaacgagtatcaataatggaaatattgacattaacacccttgtgaaagatgaatataaaaagaaacttgaaaataacattaaaagtacactaaaaaaacaatattatgttaatgctgatgttttggtagtaataaatgaagatgaaaattctgcgtattatggggatataaaaaacgtaacagttactttaaacgaggaagatataaagaaaaaagacaaaataaaaagttacataaataaaacatatatgattgatataaagaatataaatataaagacaggaagtgtatcaaatggataataagaagatttgtgatatgtttaacaaattttttaaagatagtgatagtagtaaatcattgcttgttttacttttaataatagggttatgtttgatatttttttcttctttcttttcatcttcgtctaaggaagatattaaaaaaaacagtgaagacatatcggcaaatgaatataaagaaagtttagagaaaagtatcgaagataccttaaaagatgttagcggggtaggtgatgtaagcgtaacaattacacttgacggcgaggtggaaaagaatatcgcttataatgagaacaattcttcttcttcctcatcaaatgataatacaaattcatctgataataatacttcttcaaaagatgcggtaatggtgagggaaggttcaagtgagacaccttttacaacaaaagatacatatcctgatgttgtaggagttgttgtggtagcgcaaggggcaaatgataaaaccgtagagtattacattacaaaaagtgtagaagctttattggatttgcctagttataaagtggtagttttaccaagtaataataaataaggagaatgatcatatgaaaaatgtaaagaaaaaaaatgcagtattattggggcttgttgcttgtcttcttgccataagtattgcaaattatacggtgttttataatgatgataccagcgtatcaaatgtagaagatggaccaagcaatgcaacgttggtttcaaatgttacagaagaagacatattaagcggaaatgcagagctttcttctgagtttttcagcgaatatagattaaacagagataaagttagaagtcaaaatttagaagctcttcaaaatattacaaaggatacatcacttgataaggatataataaaagaagctgtggaagaaagcgttagtatctcaaaattatctgaaacagaacttgttgtagaaaaccttataaaatcaaagggttttgatgatgcaattgtaataatacatgaagggtatgcaaatgttattgtagatgcagctacattaacaccttcagatgcagcacagatacaaaatattgtaaataaagaatgtaatattgccatttccaaaataacaattgctacaagcaataatggtgaaaagggaaattctcaagataataatcagaatgaagaaaatactaaaaacactgaaaatgaacaagaaaatctacaaaattaaattttttgacaaaatatgacaaaatacgattatatattactttatcatattttaaaataatgtaaaaatttggtagtatactatataataaaatatgattaagtaatatgggaggatgaagaaattgagaccattaaaagcaaaagttagtattaccctggatgaagagttgataaaagatgtaaaaaagttagcagaacaagatgatagatcattctctcaatatattaatgttgtattaaacaaacatcttatggaaataaagaaaaatgataataaagaagttaaataaaaaagaatagtaaaactattctttttttatttatcaattaatttataaaaatattcaggaagctcactgttaaattccatgtatttttctgttgaaggatgaataaatccgagtttgtatgcatgtaatagctgtcctgtaaacattttgtctatttttttattatatccatatactttatctccaacaacaggatgagatatatattttaaatgtactcttatttggtgtgttcttcctgtttcaagatgtacatctaaaaaagtatagtcttcatatctttttaatacatcaaaatgtgttactgctctttttgagttcgtctgagttacgcacatttcttttctttttattttatctcttccaataggagcatctattgttccttgattttcgttaatcactccgtggcatatggttttatatcttctgtttattgaatgttctttaaattgtgcagccaaatggttatgtgcatggttattttttgctattattaaaagaccagaagtgtctttatctattctatgaactattccgggtctaataactccgttaattgtagataagtcttttatatgatacattaatgcattaacaagtgtaccggtataattcccattggccggatgaactaccattccttgtggtttatccacaataacgacatcgttgtcttcataaacgatgtttattggaatattttctgcttctacgttaagagtttctatttctggcagtataacagaaatactatcattttcttctattttttttgaaggttttataatctcttcattaataaagacttttccgtctttaaagagtttttttattttttctctggaaaagtcttctaattgttctgctaaaaatttgtcacatcttttatttatatcttcttttgaaataataaaattctttttatccaaaattatacctgcttaaataaattttttaactaaaagttttgtgttacctttttttgtttgaccgttttcgctgtctataattgctctgccttttgttcttacggatatcatatcacctgctttgacattcattgcaggtttagaaacaggggtatggtttacttttactttaccgccttttacaaacatatttgcttcatttcttgaaagtttaaaaatatttcctataaccgcatcaagtctcatagatggaactatgatattttgttctttgaattttggctctacaatggttgcttgtgaaatgtcatattctttaaatgttacgctatgtccgccgattttagttagttcttttgttagaaattcacttattgtatcataaacaaagatttgaatatggtcgtcaagtatattaatatcaccaatttttgatctttctatgcttaaagataaaattgagcctaaaacgtcttggtgtcttacatcaagcgcttcttgtgattttaataccttaatagggtattctaaattttcaggttctttgttattagggaaaatactcatgacttttctttcggtatatacatgacctccaaaaaaagcgcaatccatatttttatatcttcctatttctcttcctgctaacatctggtttgtaggatccaagaaatcagaaaagacacttccatcttttttatcagataaaagtgccatatcttctattctggatatgaaaatatcatattcgttcattgtgttttatccttcgtattcccaagtatctttatgtgatgttgtgtaagaatcattaggtctttcttgagtttcaacttcaacgccatatggtgctaaaataaatacgttttgagcaattcttttcatgcttgctgcaagtacataaacagcaccgcttaaaaaatcgaagatttttttagcatcatcattttctactttatccatgtttacaacaacggtaatgccgccttttagtttatcacaaactaaaggagcatcgttaaagtttcttggttcaataagcattacagtagatgcagcatgagttgctactggtgcattatcatttcttgaacttgattttttaccaaataaaccacctctttttggttcatcttcataatattcatcttcatagtattcatcttcgtaatattcatctttgccaacaattttttcgcctaattcgcctataaaatcattaaatcccatttttctctcctttaaatatacttgtccctacacggacaatattacttccttgctctatggcaatttcataatcatttgacattcccatagatattatagttaaatctatattatcacatttgttatatgtttttctacaattatcataaatttttcttaactttctaaaaacattcacaataatttctttattgtctgtaaaaggagccatacacattacaccttttacttttatatttttaaatttcatagcattctcaaatataaaatcaacttcatcttcgttaaaaccatatttgttttcttcttttgcgatattaaattcaattaatatatttgttataacgtttttcttttctgattgtttgtttatttcttccattagccttatggagtctactgaatgtattaaggcagtttttcctattaaatttttaaccttgtttctttgaagatgaccgataaaatgccagtttatatcttcacctttaaaaaattcatattttgattcaaattcttttactttgttttctccaagattatttattccaaaatctaaaacttcctttatttcatctgttgttctgaattttgttacagcaaggagtgtaacattttcatcaaatttgctgttgtttttgctattttcaatgttttgtagaatttgtgctaaattatctttaatactcattttaaacctcctatgttggatttgatattatttccatattttcctttaaatcagggttttcacttggtttaaggagtacggttctaaattcttcactgtaaattttaacttcaaccagttcttttaaatttccgtctgtaacggcatatacatatgttttaccatctttttctataattgctttcttaggtattttataaacagttacttcatttgtatgtatatcaagttttgttttatctacattaattagatggctaaattcatcttttaaacatataaccagaatttttttatcttctccgtaatcaagggaattgattaaataaccttcatctgttttcccttcgttatcttcaaatttaatagtaggatacgttattaaaatatcaactcttgtaaggagataatcataataatctccgtctgtttttaaatcgtggtttttcttaacagatgcattatattcttttgcttcttcttcaccttctacatatgtatctttatttactactgcgcaaacatatgcacattgattgtttactatttttattattgatttatcttcacttgtactttcaggtttgaagttttttaaataatcaatatagtcactatctaaggctgccattacattggtatttaaaacttcttcgtaccctgttcttgaaaaatatatatttccggtaaaagaaaagtttaagttagatattgtaaggtctttttcatcagaactcattttgctttttagttcttctttgagtttttttaatgtttcgtcatctgcaaaaatatatttcatggatttttgcatcatttctttttggcttttaagttttgtcagttctgtgctgtattcattcatttttgttgtattgtttgttgattttgcctgattataattattttcaacattacttatttcttcttcgagtttatttaaatctttgaaaaagacatcacggttttcataagaatcgtttttaagtctccagtctataacgcttatggcatcatctatatatttgtttgtttttattttgtatgtttttgaaagtatagtattggcacctactttttgtccttcttttacagtatattttattgatgtgctttcatttaaatcaacatattctgaatttgtgaaaatataactttcagcagtttctgtcgttatatctttttgtgcatttaaaagaatagtattttcagaatgcaatatggaaaataaaaaaaagaccaaaatagaacccaagataattatttctttatatcttttttgaaagaaattttttttatgtcttttccttttaatcggaatattttgtgaaaccattaccggattgttatttatgtctttattttttcttttcatagttatatacctcttatataccttttaacacaacaaaaattgtagagaaaaatattttaaggtctaaaagtaaggaataatcatttaagtattcaaggtctatttttacaacttcatgaatatttaattttgatcttccctttaattgtgcaagccccgtaagtcccgggtatgcaatatttctttgcagttcatattcattaagtaaatttgtttctataggtataaaaggtctcggacctataaggctcatatctccttttaatacattaatgagttgtggtatctcatcaaaacttgtttttcttaaaaattttccgaattcagtaactctagggtcttgttttatttgaacaaacccatttctggatttctttaataattttttctcttccttttcgcttccttctttcattgttctgaatttaattatgttaaagctttttccgtatctgccaattctttcctgaacaaagaatattttcccgccgtcggaaagttttattataattgctattactactccgggaataataaaagctatgcaaagtaaaagagaacatataatatcaacaagtctctttacaatgatagtgctattatatttccttattttttctttacttatttctttcataatttttccttatataagtaataatttgctgattatatattatatcattttataataatttttacaaatatttctttaaatggtataaaaaatttaaaaaactaatataatgaagaaattttatggtataattaaaaattataaaacctatggagaaatttatgaggaaaaataaagttgttaaacccaaaaaagtcttaaaaaaacattctaaacataaagcatatgaatcaaaaaaaacaagaagaaaaaaaatatgtattatattaatgacattgcttattatattttcttcaagtggactgggacttgcaaagtctttaggatataacgtactaaatagtaatccttttcaaagtccaaaatatataaggttaagtgataaaacaaaacttaacaattctgcaacattggaagatacaataaatatacttatattcggtattgacaaaaacgaagaaagaagtcagtctgcgacaatttttagacctgatacaataatgcttgcaagtataaatacaaaagataaaaccataaagcttatttcaattcctcgtgacagcagggtggatatatataatagaggtggaagagataaagtaaattcatgtttttattatgcgagtcttggtttgtctgaagcagatatgaataatcaagaaaaattatttgatacgggtgttacatatttaaaaaatactgtaagcgatattttaggtggagtacaaatagattactatcttggtatagatatggatgcacttcctcagattgctgatgtaatggggggggtaaccatagatgttcatcaagatttatatgcacacaatggttatgatacttctcaaattgtaataaaaaaaggaactcaggttttaaatggggagcagcttctttactacagtcgatacagagcatatgttgacggagatataggaagagttcaaatacaacaaaaaataatgaaagcaatctttacggaatttaaaaataaaggaactttttctcaaattccacaaatttataatcttgtacaaagtatggttgaaacagatttgcaatttgcacagattgcatctttagggttatcttttaaagatttcaacatagataatttacaaacctatacattacctggcaattttggtaatttgggcggagtttcgtattggatagttaatcaatcggaaagagtaacctttattaaagagttatttaacatagatgctgagcagttatctcaggatccaaggagtgattaaaaatatgcaaattaacataaatagtttaagtaaaagttttggaagcgaacatttatttactattgattcccttgttataagtgataaagataaggtgggcattgtcggcagaaacggagccggcaagtccaccttgcttaatgttttaatgggaattgatgatgattatacgggcaatatttctaaaatagataaagataaaataggatttttaagacaaaatcttaatttgaatttagataatgatatctattctgaagttttattaggtgcagaaaaatacacaaaaaaagaagaagaaatagaagagctatctatgatgcttgagtttgaatcggataaacaaaagcttatagaattaaatgagaaatatcacgaacttgtaagtgagtttgaagatatggacggatataagtataaaagtttattggttgggattataaaagggcttggttataaagaagaagatttttcaaaaaaaatcttcactttatccggagggcagaaaatgagagtagcccttgcaaagttattggtttcttctcctgaagttttaatacttgacgaacctaccaactatttggatacggacagtatttcatggctggaaaatttcttgtattctttgaaatcaactgttattgtcgtaagtcatgatagatatttcttggataaattcacaaataaaataatagaaatagaaaataagaaatgctatgtatacagcggaaattattctgactatgtaataaagaaaaaacaaagagttgatattgaaaaaaatgcttacaacaagcaacaagcagaaataaaaagacaagaagaagtaataaagactctaaagcaatttaacagagaaaagagcattaaaagagcaagaagcagagaaaaaatgcttgaaaaaatggaaagagttgatagtccttattatgctaagaattcttatataaaatttggatatattccaatgataagtaaaaaagcaataacagttgaaggacttgactttggatatacaaaagaaaagaaattgtttaatgattttaatattaccatttcaagcagtgacaggcttggtatttgcggaagaaacgcaaccggaaaatctacttttttaaaacttattaccggtattttgaaagaagacaaggggcttataaagaaaaatcctaaatgtcagattttatactttgaacaagaacataacgaccttgatgattctctaactattttagaagaacttagaaaatctacaaatgctgatgatggtgaaataagaaatattttgggatgtatgctttttagcggtgatgatataaacaagaagatttctatgctttctggtggggaaaagagtcgtgttgccatcgcaaaactcatgatgaaagaatccaatgtgcttatacttgatgaacctaccaatcatttggatattgaaacaaaagaagtacttgaagaggctttattaaaatatgacggagcagtcataagtgtaagtcatgatagatattatttaaataaaatatgcaacagaataatgtatttgaccggtagcgatataaaagtatatgacggtaattatgactatgcgatggaaagagaggctcttttaaatacagaaaaaatacaggaaacaaaaaaggaagtaaagagcgaaaaaaaagaaaagaaaaattcatctttaagcaacaacaagagaaaagcatatgaagaagagcttaaaactatagaacaggatatagaaagtttggaagaagaaaaaactgaatttgcaaataagatgaatgaccctgaatatttcaatgatgtaaacaaggcacaaaatgtttccataagattaaatgagatagaattgttacttgaggaaaaagaatcaagatggcttgaaatcagtgagattttagaaaatgattaatattttggctatatattgtttaatatatagcttttttaataaataaaaagaaggttttgttatgcaaaaggtaaaatctttatcgaaaaaagaaatagatgatatcgttaaaatttatgttgagtcaaatttaaatgaagagggtacgatttccttatttaaagatgagaatacatttaaaagatatttaaaagtactaataaaagcaagtattaaaaataatatgttgtattctttaagtgaaaataatgagggatttattatattaaacagtactttaaatcctttaagagtaagtgctaaaatatatatgcttttaaatattattagaatttttggatttaaaggatattataattttttggaatcaatgaaaagtgataaagtttctttaatagataaatttaggaaggaaaataaagactttatagaagtggaaatggttcttataaaagcagagtttcaaaataaaggatatatgcataaaattatgaatgaaattcttaaatttgcagatgagtattctcttcctgttatattgtcaactgacagcgagcttaagaaagataaatacgtgcatataggtatgaaatatttatataaaagaaaattaaaaggcggaatatatatttatgaattaataaaagaaaaaaaagacacttaaaagtgtcttttttatttgttttataatctttcaattactttctttgtaaattcttttgttccaaggtttccacctaaatcttgtgttaggtatttaccttctttaattaattcttcaattgttttttctattctagcgccttcttccttgtaacctatatagttaagcatttttgcacctgcaagaatacatgctgtaggatttgctatgtttttacctgcaatatcaggggctgaaccgtgtacagcttcaaaaattgcaccgtcttcaccaatgtttgaacctgttgtaagaccaagaccgcctattaatcctgcacaaaggtcgcttacaatatctccaaataagtttgttgcaagtaatacatcatatttttcagggtgcataacaaggttcatacaagctgcatctataattaaatcattaagttcaatttcaggataatccttatgaacttcatttactgcatctaaaaatactctgtctgtaagtttacaaatatttgctttatgaagagctgttaccatttttctgttttctcttcttgcaagttcaaaagcatattttgcaattctttcactggctttttttgtgataagtcttgttgtttctgctccgccttcaatttctttttcaattcctgcatatagtccttcagtgttttctctgattattacaaggtcaatatcttcatatctattttttagtccttcatatgtttttacaggtctcacgttagcataaaggttaagttcttttcttaaagttacatttacgcttctaaatcctttacctacaggagttgttacaggtccttttagagctactttgtttttctttatactatcaattacttttttaggaagtggttcaccgtatttttcaacggcttcaagtcctgctatttcttcttcaaaattaatttctgcgcctgttgctttgattacttcaacggcacttgccattacttcttttcctataccatcaccataaattaatgttacgtttttcatgaatattctccttttttaagcttaactgttattatactttacttaaagacatttaacaatagtaaaatgtctaaatattcaaaatattagacactcgtattaactggtattatttgacataaccgtgttttttatagtaaaattataaaagataattaagtttgaatttaatgatttttatatattattttaaggaggagttatggactataaattacttatcaccgatttggacggaactatgcttaattctaaaagcgaaattagcgaaaggaatttaaaagcagttcatgaacttcaaagaagagggaaatttataagtgtcggaagcggcaggctttatgttgatgcaataaaatatgcaagacaacttggttgtcaatataattacaatattgcaaatgcaggtcttacgatatttaaagagggtgaagaagaatatgttgctcattttgaagaaggatattataaaagaatagttgatattttaagatacaatcatattccttttgtcgttatgacaagcgattatgaaggttctttttatgatgaaacaagtgaagaatttgtccatagatgtagagagttaaatcaaggaacgctcattgattttattgaagctgatgtaagagatttaaaaaacgtatataaaataagttcttcttacagaaatgttgatgatatttttcttcatagagaagttgaaagattaaaccgtcaaataagagcagatatatcaggagaatattttatagatttatctccaagaggtatttcaaaatggacaggtgcaataaggcttgcaaaagaaatgggaatatctacaaaagagataatagcagttggagatcaggaaaatgatatgcagattgttgcaaatgtagggcttggtgttgcaatgaaaaatgctgtggacagtttaaagaaagtagcagatgttgttcttccttataccaatgatgaagacggagttgcttatttaatagaaaaatatatgctttaaattgataataataattggtatttgtttaaatgatagggaggattttatgaaatataaacttattgtaatggatgttgataatacgcttttatgcacagataaaagtatatcaaagaagaatctaaaagccataaaaaaatgcatggataaaggtgtaatggtttctcttgccagtggaagacctgcacttgatgttttatactttgcaaaacaaataggtatagaagataattatcacgtttccgataacggtgcaggaatatttaaaggtaatgatagaaaaataataaaagaatttaacagagatttttatcttgatttaatagataaacttaaatctaaaaatatagaatgtggagttttctccagtgaaaactttgattttgtttatgaagagggcgatgatgtaattgcaaagggaataaaaatatacttccctgttacaaaatcaagaataggtaatattaaagatataaaaggagtatacaaagtaagtgcatattttcataatgatgaagaatatgaatttgtaaaaggacttgaaaaagaaggtgaaatgcaaggtgtagtacctgatcctaacttttttgatatgatgccttataatgttacaaaaattgaaggtacaagagcaatagcagaaaaacttggaatttctatggatgaagttatagtaatgggagaccagggtaacgattatacaaatgtaaaatatgcaggtcttggagttgctgtggcaaatgcaacagatgatttaaaagaggttgcggatgtggttttaaagcaaagttgtgatgaagatgctgtggcttatgtaatagataaatatattttaggagaatagacattgaagtacgaattgcttattacagatcttgacgatacactattaaaagatgacggaacgatttctaaaaagaataaagatgcacttagaaaacttataaacagtggtggtaaagttgctcttgcaagcggaagagcagagccagcaatggaaaatgttataaaaatggtagggcttagtgatcaaaaacatcttgctcataatggacttagtgtttttaatttagatggatacagaaaagtatacaattttattccaaaagatgagattaaaaggattttagatttattaaaggtaaatgatatagaatctaacgtacttagcttagatggaatatttcataatcatagttataaacttgttgatgttatggataagtatgaacatggatatcctgtaattgatgttgattatacaccttatgatatagaaaatatattcttaatgtatgggcttattaataatgaagaacaaagaaaaatgatgcgttcatgggggaatgatgttatagaaacgggagagggaaatggttttgtaatattctttgtaaggggagaaggaaagtttcaaggtgcaaaaagacttgcaaaagagtttgggattgatgaagaaaaaatagtatgtgtgggagacggagggaatgaccttcaaatgcttagggatgctcctcttggaatagcagttaaaaatgcagtagacgaagcaaaagaagctgcaaaagtagttattgataaaacaaatgaagaagatgcaataagttatgtaatagaaaaatactttttaggagaataaacatgattaaattatttgcggtggatttagatgatactttacttagggacggtaatataatttcaaaagaagacaaacaggctataagagatttagaggaaagtggtgttaaggttgttattgcttcgggaagaagtgaacctactcttaaagatgtaatattagaacttggacttgaaaaaaataaacatgtaggagtaaatggtgcattagttcttgatttaaatggaaaaaatgaattttctaaatacattgacagggatacatatgtaaaccttatagaaagattaagaagcgaaaacagagaatttttctgttactgcgatggggggcttatgtatgaacatgtggataaacttagacctcaagttgagtatttccactctgcaaaggctcttattaaaggggatgttatgagtattcctcagtgtcctagagtaaatacatattatggtgatgaagaagagctttcttatgtaagaagtatatgtcctgaaggtttgtattcaactgcaaatagcggtattttggattatatgccaataggattaaataaattttcagggttagaacttgtattaaaggaatatggaatagataaaaaggatgttgcatgtataggggatcaagaaagtgatcttgatatgttcaataactgtggatattcttttgcagtaagtaattgcgatgattttgcaagagaagctgctgatatagttcttccaagaagtcacaacgaaaacggtgttgcatatgcgatttataaatatttattaaaagacgaagataaattatcgaagatttaagtagaaaaaaataaataaattcggtataatagccatggcttaatgttatggctattaattttatggaggaaaaaatgataaaattattcgcagtagatatggacgatactttcttggataagaatgataatatgtcaaaagaaaacatacaggcagtaagagaccttgtagatgcaggagttaaggtagttataaattcaggtagaacagaagttttaatgagagaacatattcatgatttaggtcttgaatatgttaaacatgttgccgtaaacggcgctttaattcttgatgttaaaggggaaaatgaacttatttcttattttaataaagaagattatgataactttataaagattttaagaagggaaaacagagggtttttctgtttccataaagacggaataatgtatgagaatgcagatgaaaaacttatgaaccacataaaaagattccatactttgaaaatggcttgtgaaggagatactctttctcttgataaatgctgcagagtagcggttgtaagaaacaatgaagaggatgttccttatctaagaagccttgcacctaaaggagtttatacaactgcaagaccttttggttcttgtgtaagttatatgcctgacggacttaacaaagcaaacggcttaaaagtcttaatggatgaatatggaataaatagtgaagaagttgcaagtattggagatcaagaagtagatacatatatgtttgatatatcaaaatatgcatttgcagtaaaaaacagtgatgaaaaaacaaaacagagagcaaatatagtgttgcctagaacaaataatgaaaatgcatttgcttatgctgtttataagtatattttaaaagatgaaaataaacttaaattagtttaaaaaaagaacgcatatgcgttcttttttatattccttttttatataaaataaatgagtatgcaattggtactattaccattactgctacactagttaagaaaacagcttgaggtaatctgaagaatgccgatgcaatttgaattattcctgctataacccatatgaaaccggatagtctatgagttttgttccagttttcttcactgtttaatgtccatggcagttttactcccattgtgtaattttgtttgcattttggaagatagtttccaataataataaacaccaaacccattaatgcgagaacaaaagtcgatgtatttatattttcataaagagcagataatatagatataaaacaaaatagaattgttagtatcggtattatccatttacttaatgtaaatataacctttgaagcattttttctttttgggtcattatttataaatacatttaccagcaagtttaaagcagcataaacaaaaggcattacaaagataaatacttcttttgatacatatccgtcgggatttcctgatgcgtcaaaatgtatcggtaaacttgttggaagtttgttgtatacaaaaagacataaaattgtaggtataaaacaacatattgttgaaaggattatttctttatttatttttattttcatcttttcctccgctgaactgagataaccacaacattaattcttcaaatacagatgtgtttatatcgtagtaaataaagtttttatattttgtttcgaatattaaatccgcttgttttaattttgataaatgataggataccgttgctgcagtcatatcgaattttgaagcaatttctcctgccgacattctgccgtctttaagcattacaagaatatctcttctaaccggatcagacagtgcctttagtgtgtttgcaaaactcactttgttatctcctttcttctatttagatatttttctaaatagatattatatctttcctataaaaaagtcaagaactatttagaaaattttctaaatagttctcttgtttaaaatattattgtatttttgtattattttatctttttctttattgtctaattcatttatagggataatggctttaggatatttttcaaatttgccaatttctaagctataccatgctgtgtcataccagttattatctttatacccacttttttcaaaaaatcctatttctttaaatcctaatttttcatggaatttattacttcccagtgttttatgtacggttatacaggcatatactattttaaagttttgtttttttagtatttctattaatgccatgtataaattttttcctatgccttttttattatatccctcttttatatatatagacagttctaccgtgtagtcataggcttttcttcctttgtattcacttgcataagcatatcctataattttattattttcttcacataccaaataaggatatttacttgttatttttcttattctttctttaaattccttaatacttggtacgtcatattcaaaagtaatgggagtatttaatatataaggttcgtatattttaagaatgtcttttgtatcttcaattgtaacttgtcttatgtttaatttgtccatttataataccttcttagtttataataattatctattttaaattaaataaataatatagtcaattttaaattaactcaatttgaatgtttaatgttatatagacttaatatcaaatcaattgtagtaaaaaataagagagtaaatacagcatatactatggctctttgagataagttttcttttacaatttccagtaaaattggatgaagaaagttaagcagaaaaagcccaaaaactccaaatactataaacccaatggcacagactctgccgtctaaattaaataagttatttgaataatcccagtattttttatcaaattttttttctaaaatgtaagagctaatatattctatggtgcatgaaaaaaatccaacaagaaaaaataatggaagagtatctatatggaaattataaaaaactaatataagaagaatacatccaaaaccgtaaatgggtcttaaaggaccgtaaagaaatccccttgagttaattggaactttgttttttaaattaattaatgtttcataaatatatccaagaaaactatatataaatataaaaagaatggttgtaaagaaattcataaaaataccttttattttttataatgtgtaaaactaaataaaaaatacgaaaaagaataaacaaaaagaaatttttttcatagtatattttgaaggatattattttggaggtaaatatggtagatgtatatatttctccgtcagtgcaacattttaatttaggttatgacgggtttggaagcgaagaagaaagaatgaacgagattgcggatattgttgaatacgaacttaacaggcatgggcttgtaacggcgaggaattctcctaatatgactcttgcacaagttgttgaggattcaaacagcattaaaccgagggttcatgttgcaatacattctaatgcttcaaatggagaagccagaggtgctgaaatctatgctcacaggtttggcggtgaaggtgaaaaacttgcaagggatatttatccttatcttgaaatgttaacacctactgatgatttgggcgtaaaagaggggtatttaacctttaacggaaaaggaatgtatgaacttagaaaaacagtatctcctgcggtgcttatggaagttgcttttcatgataatccagaagacagcgattttatcataaataatatatatgaatacggtgtaggtattgctaaaggtatacttgattattttaatataccttatgttggagacagtaaagaaaatattgattttttaaaaaataaatataacggaaaatattatgaataaaaattgctttcttttttaataataaaataaaaaaggaagttagtatggataacacaattaaattattggaatttatttataaaaatgcaaaaatgggctcaacttctattgaagatttgatagatgttaacgaagatttaagatttagagatgaacttgttcatgagaaagaaacttatgatgcttttgttaaaaaagtaataaaagtaatgaatgatatgggcaaggaagtaaaagatttatcttatttttcagaacttcaaagttattttatgataaaaatggaaacaataaaggataaatctgttgaacatcttgcgggaatgatgatgcagggaagtacgatgggaatagttcaaataacaaagaaaataagagattataaagacagcgacaaaagagttgttgctttagcaaaagaacttcttgaaatagaagaacagaatttttatgaacttaaaaagtatttataaaacaggctatgcctgttttttagtataattaaatttttatttcatatatttaattgatgagaagaaaattaaatattaaaagaaaattttataaaaaagtattatattttattttaaatttattttttacttttattattttatatcctgttttaaatgatattgatacaatattctatctatttaataaaaattatattataagtaaaaacgaaacaaaccttatagaatataaggctgaaaaatctgattttattaaacctgtggagggagtaattacaagtgaattttcttatagaattcacccaataacaggtaaaaaaacaaaacataacggtattgatattggagcaaagtggcatgatgacataaaggcaacggcagatggagaagttgttgaagtggggtgtgataaagaagggtatggaaattacataaaaataaaacatgagtatgacatatattctttttatgctcatctatcaaaaataagtgtaaaagaagggcagaaggtcaagcagggatatgttataggaaaagaagggggagatcctaaaaaagataagaatccaggctcctctacggggcatcatctgcattttgaaataaggacatcttcagatgttaaagattgtataaatcctcttatatttgttgattataaataaaaaaagagcataagctctttttttacaaacaattttattttagggaaatatatatattattttaatgagttaattagttctactaattcattttttgaaagtcttccttgagatctttctacttgttttccgtttttataaattaataatgtaggaattgacattactctatttttcattgcaagcattctttcttcatcaacgtttaccttgcatatttttacatcatccatttcttcgcttacttcatcaattataggtgaaaaagcttggcaaggtccgcaccatggagcccagaaatctactactaccaatttgtcatcattaatttcacttttaaatgttttatttgttaaattcattacactcattttatttacctcttttcttatctttgattatattataaataaataaaaatataatacagtgactaagtcacatagagatgaaatttataaatttattgacataataatgttttataaaataaaataataataattggcaaagaaagatatgaaaatattattagtagcacttttaactttatttttaatattaaatgtaggtgttgtatatattttgcaaatgaaaatcaaaatagagatgaaaaagattctgttgttacttcaaatggaatagcgctgagaatgtagatttttatatctacataataaatgtaaacaacttactcttgcaaaagatattgattatgttattaaaaaagagataacagataaaagtatagatttttatataacttttaaaggaaattatgaaggtgtagttaaagaagagtgttaatataaaagatagtgaaaatatggaagtcgtaaaaaattaaaagaagaaaaataaaaagggaaagaaaatggaaacaaataatatagaagaaactctttcttatttaattcccgtatgggacaaaatggaagaaaaacataaaaatcttattttaaataatattgaatataaaacatttaaacaaaatgatgctgttcatgacaatgatgtaagctgtcttggtttggtacttataaaaaaaggtaagcttagagcatatatggtttctgagagtggaagagaaataagcctttattatctaaatgatatggatatttgtttaatgtctgcatcttgtgccatgaaagatatctcaattgatgtgtttatagatgcgatggaagaaagcgaagtcataataattcctacaattatatataataggatttcaaaagagtctttagttttctcaaattatataaatgaaataatggcttcaagattttctgatgtgatgtggcttttagagcaggttatgtttaagaagttcgaccaaaggcttgcggaatttgttctttatcatatgaacgacgataaaaaattaaatatgacccatgaacaaattgcaaatcacctaggaagtgccagggaagttgtaagcaggatgcttaaacattttgtttcttgtgggtacataaaattatatagaggtggtattgaggtagttgatgaaaaaggtcttaatcgtattagtgaatgaaatgaataaaaatatataaataagggagaaaagatatgttgcaaattgatttaacaggaaaaaaagcttttattacaggaggaagcagaggcgttggaaaagctatttgtcttacattagcagattgtggagcagatgtagcttttacttatctttcaagagatgaagcagcaatggaagtagtaagagaaattgaggatatgggaagaaaagctttatgctataaatgtgatgttggtaattttgagcagatgaaagaagttctatcggatgttaaaaataagtttagtaaacttgatattattataaataatgcgggtggctctaaggtatttgaaattgatgagcttacccctgaatatcttgacagtgtattaaaatcaaacttatacggttctttttattctataatggcaggcggtttggatttattaagagaagccggtggaggaagtataataaatataggttcttctgcaatgtattcaggtatgggcggaggccctcagtattcttctgctaaggcagggcttatgggacttacgagatatatggctgttcaatatggcagtgaaaatataagatgtaatactcttgcaatttctcttataaaaacagaacagttaaataagtttgatgaagaaatgacaaagaaaaaaatcgctactgttcctgttggaagacttggtactcctgaagatgtagcttatatggcagcattcttatcaagtgatatggcaacttatgtaagcggcgaaattatccttatggatggtgcaagaacatatgcaaaataaaactccttatgggagtttttttgtttttataaatgaattatataagttttaaataaatcattttgtaatattaaaatttcattaaaaatagaaaataaatttaaataatctattgacaaagtatagtcgtggtggtatatttatgacagtgttagcactcatgtttaaagagtgctaataagaaggagaaaggaaaatgaactgggaagatagaaagtttattattttaaatgcaataatacatgattatattaaaacagcagaacctgttggttcaagaactcttgaaaaaaaatataagcttggtgtatcttctgcaactatcagaaatgaaatgtccgatttggaagatatgggcttattaataaaacctcatacttctgcgggtagaattccttctactacggcatatagattatatgtcgataactttatgaagaaaaatgctttagatgaaaaaataagagatgttgttaaagctgagtatgaaaattatatgtttgaacttaataaaacaatagaacaaacacttaatattcttactaaaatgacgaattatacttctcttgttatggctccaagactttcatctttaaatgtaaaagacgtaaaacttgtttacattgaagaaaaaagagtcatgattatcgttgtaacaaaagaaggtcttatcaaaaatgcagagataaggttaaaatacagcgttactttagagcagctagaaaaaataaataatttccttatttcaataataagaaacagacctgcaaatgaagtaattgaacttctaggtaaagcaattgacggtttaagtgaagatgaaaacagaattttatcggaaataatgcctgtatttagaagtttagttgaaaaggcgcattcttcaaagatttattctaaaggagtaagcaaaatattaaactatccggaatttgaggatttggaaaaagctaaacactttattgattctgtaaacagcaaagatacattggaaaatgcaatactatctgctgtggatgatgataaagatattcatatagttataggtaatgaaaacaaagttgaggactttagtgattgttcgattataactgccgattataaattaaacggcaaaacaataggaacaattggtgttattggtcctacaaggatgaattacgattatgctatttcaacacttgatgttttaagtgatgaactaacaaagcatatttcaaaaatatttgaaaagtgaggtagctaaatggataatggtaatattaaagatataaatgagcttagaaaagaaaaagaagaaaaagaaaaacaaaaaaatatgaaagatgaagaaaaagaagtgaagaaagaagaaaacaaagaacagataaaagaagaaaaagtaaatgaaacaatagaggaaaaagaagaagttaaagaagaaaagaaagaagagagctttgaagaaaaatataataaattaaatgagagctatcttagaattttagccgattttgataattataagaaaagagctgcaaaagacagagaggcaatgattatttattcaacatctaaattcgcagaaggcttatttcctataattgacaacttcaaaagagctcttgaaagtgaggaggataaagaaagcggtttttatgcaggtgttaacatgatattcactcaattaagtgaactgttaaaaagtgaaggaattgagacaatcgaagctattgataccgcatttgatccaaacaaacacaatgcggtagcagttgacaaggttgaagataaagaagataatattgttcttgaagtttttcaagacggatatgtttataaagaaaaagtcttaagaccggctatggtcaaagttaataagttaaaatagattttataaaaaggagagatttaaaatgagtaaagaaaaaattataggtatcgatttaggtacaacaaattcatgtgtagcagtattagaaggtggggaagctgttgttatagctaatgcagaaggcgcaagaactactccatcagtagtagcatttacaaatgacggagaaagattaattggtcaagtagctaaaaaccaagcagttacaaacccagaaaaaacagttgcttcaattaaaagacatatgggaagcgattataaagttgatattgatggtaaaaaatatacaccacaagaaatttcagcttttgtattacaaaaattgaaaaaagatgctgaaagttatttaggacaaactgtttctaaagcagttattacagttcctgcttactttacagatgctcaaagacaagcaacaaaagacgctggtaaaatcgcaggtcttgaagttttaagaattatcaacgaaccaacagcagcagctcttgcttatggtcttgataaagaagaaaatcaaacagttatgattttcgaccttggtggtggtacattcgatgtatctatcttggaacttgctgatggcgtatttgaagttaaagcaacaaatggtaataaccacttaggtggggatgactttgataataaaatcattgaatatctaatttctgaattcaaaaaagctaacggtattgatttaagcggcgataaaatggcaatgcaaagacttaaagaaagtgctgaaaaagctaagattgaactttcaagtaaaacaacagctcaaatcaatattccattcattacaatggacgcagctggtcctaaacatttagacgtaactttaacaagagctaagtttgatgaacttacagcagaccttgttgaagcaacaatggaaccagtaagaaaagcaatcgctgactctggtttatcagcaagcgatattcataaagtagtacttgttggtggttcaacaagaattccggcagttcaagaagctgttaagagaatcacaggaaaagaagctgataaaggtatcaaccctgatgaatgtgtagcaattggtgctgctattcaaggtggtgtacttgcaggggatgttcaagacgtattacttcttgatgtaactccattatcacttggtattgaaactcttggtggagtattcactaaattaatcgacagaaacacaactattccaacaaagaaaagccaagtattctcaacagctgcagatggtcaaacagcagtagatattcatgttcttcaaggggagagaggaatggctgccgataataaaacattaggtagattccaacttacaggaattcctgcagctccaagaggagtaccacaaatcgaagtaacatttgatattgatgctaatggtatcgttaatgttacagcaaaagatttaggtacaggaaaagaacaaaacgttgtaatccaatcttcttctaacatgtctaaagaagaaattgataaagctgtaaaagaagctgaacaatatgctaacgaagataaagcaaaagaagaagaaattaatacaagaaataacgccgatgcagcagtttacaatgctgaaaagacattaaaagatcttggcgataaagtaacagatacagaaaaagctcctgttgaagatgcaattaaagacttaaaagaaaaattagaaggttctgatacagaagcaattaaaaaagcaacagaaaaattaagtgaagctttatatccaatagcagaaaaattatatgctgatcaagctaaccaacaaaacgcaggtgcaaatgctcaaggtacaagcgatgctggaaaacaagatgataatgttgttgatgcagattatgaagtagtagatgatgacgataaataattaaaacaacttcaccctgctaagtagatactttgcggggtgatttttcaaatttaaaagggagtagataataatggcaaaaagggattattacgaggttttgggcgtagataaaagtgccagcgaagctgatataaagaaagcatatagaaaacttgctatgaaatatcatcctgacagaaatcctggtgataaagaagcagaagaaaagtttaaagaaataaacgaagcttatgaagttttatctgatgctgataaaaaagccaaatacgatcaattcggtcatgctgcttttgatccaaacatgggcggtggagccggttttggcggtgccggatttggtggatttgaagatatgtttggtgatatcttcggttcaatgtttggcggcggattttcttcaggtgcaaatagacaaaatgctcgtcaaaaaggtagagatttaagagttaatctttcaatatcttttaatgatgcaatttttggatgtaaaaaagaaatcaaattaaaaagaacagaaacttgtgaaacctgtgcaggcaggggggctgtaaatgatgctgacattaaaacatgtgaaacttgtcatggaacaggtcaagtaagagtaactcaacaaagcttgtttggaactgttcaaacagtaaaaacttgtagtgaatgtaatggtacaggtaagaaaattattaaaccttgtcctacatgttccggcagcggtactgtaagaaaagaaagagttatttcaattagaattccggcaggtgttgatacaggaagtgttcttcctttaagaggcgaaggtgaagccggtaaaaacggaggtcctaacggagatgtatatatttacataactgtaaaacctcatcaaatatttacaagagacggtagcgatatttattgcaaaataccgataacttttgttcaagcagctttaggggatcatataatggtgcctactgttgatggacaggttaaactaaaaattcctgaaggaacacaatcaggtcaagtatttaaacttaaaaataaaggtattcaaaatgccaacggttttggcaaaggtaaccaatatgttgaaataaaagttgaagttcctaagaacttaacagaaaaacaaaaatctaagttaagagaattcggggaactttcaagtgataaaaacaatgaacaaaataaaagtttctgggataaggtaaaagataactttaaataaaaagacttctttagaagtctttttttatgttatattataaatataaattttggaggaaataaagttatgcttgatagaataccaagtaaagaggatatgacagttttggtaggacaatctttatatgatgtttgggaaaagttgtgtaatttaattgatgaaagatatgaaatggataggttatggaataccggcggtaagaaatgggcttatgaatataaatatctaagaggtggtaaaacactttgtgcattatatgctaaagaaaattgtataggatttatggttatacttggaaaagaagaaagagcaaagtttgaagaagggagaaacatttattctaaagaagttcaaaaagtttatgatgaagcgaaaacatatcgtgatggtaaatggataatgtttgagccaacaaataccgagcaatttgatgattatattaagttacttactataaagagaaaaccaaatagaaaataatatttttaagttatatattttagatgaatttaattaaaatttgtgaggtgaaaataaagtggaattggaaataattgaaataaaagacagagattctattttaatacagaatttattagatgtatgggaaagttcggttaaagctactcatttatttttatctaaagaagaaataaataatattaagaagtatgttccttttgctataaaagaagtacctgttttagtgatagctaaaaatgtagataaaaacataactggatttatggggactaaagataagattcttgaaatgttatttatttcagataaatatagagggcagggaataggaaagatgttgttacaatatggaataaaaaattataatataaatgaacttacagtaaatgaacaaaatccccttgcaaaaaagttttatgagtatatgggctttaaagtttataaaagaatggagctagatgaacagggcaatccttatccattattgtatatgaaaatgactgaataaatttttaaataaagtattgaatctattaacgttttttattattagtcattttataaattaatttattaataataaaaaagagaagttttaaacttctctttttttattctacgctttttagtgattctaccatgttaatttttttcagtgttctgtttaagaaaatatttactattaccgcaaatacaatcgtaagaactacgccatatatataacttgatattaaaatatcattataaaattgtacgaagtcaacagcaactgtgttcataaggtattgatggaagaattttcctattaagcatcctactattataccgattatattaagtataatattttctcttacaatatataagtttacttcattattataaaatcctaaaacttttatggttgcaatttctctaaatctctcacttacattaatattatcaaggttaaacattactataaatgctaacatccctgctgcgataattattacaacaataacaaaatccaaactgtcgagctgttgagaaaatccttctgccgttctttgattaaattcaacacttaatatatttttgtttttcaaaatttctttacttagctcatcataagtttcttcatcattatttgtaagtcttgataaaataagatttgcatttacatcttcatttgttaattgttcataataatctttactgatgaatgcatagtggtaaatataattatttactacccctgctacagaaacttgatattcttttccgtccatatcttttattttaattttatcgcctttttttattcctgctatttcacttaatctgctggttattataatgccattatcaggaagagttaaggtttgttccgtttcgtagtcggttaagtaaatatagttgttcattgcatcagtatctatcggaaccattaaagagaaattataactttttttatctccttctacttcataggtatcttgatagaatagtttgctttcttttatttcgctgttactattaaattcctgttcaatctcttttatttcttttgtagatacatcgctatccaaagatgtttccatgttgtaatttcttacatgagtatattgtaaatctatcattgatgatactgaatatctaagcccaaatcctgcgattaaaagtccgcagcatgcgccgatccctaaaacgctcattataagtcttttcttatatctcataagatttcttattgttattttccatttaaagcttaatctgttccaaataaaaggaattctttcaagtaatgcttttcttccgcttttcattacttttggtctaagaagacttgctgcaacttctcttaagtctgaactgcaagctacataagcactgagaaccgtacacatcacacctactataagagaaataacgatgtagttaggataaattacagggataagttcaggtgttttatataaaattctatatgcttcataaatcatgtttggaacaaatgtaaatcctatgataagtcctataatgctgccgataaaacttgcaaggaatgcataaacaataaatttcatgcttacggcaaatttgccaaatcccaaagcttttaatattccaagttccgttcttttttcttcaaccattcttgtcatggttgttaagcatacaagtgctgcaacgaggaagaatattaaaggaaatacttttgcgactgatgttattttttttgaattttctgcgtagctgaaataactttcgtttgtgtttctgtcaagtgtataccacttaacttcttccatatcttcaacttctgcttttgcatcatctattttcttttgtgcatttgcaaattcttcatctgctttttctttgtttttgttgtattcgctgtatccgctgtcaatttctttttgtgctgatgttatttggtaagatgcgtttgcaaattctttgtttgctgtattttcttgtttttctatttcgctgtatccgcttttaatttctttttttgcgtttgtgatttgagtttgtgcgatgcttaattctttttcttttgtctctaattccgtttttgcatcttttaattcttgttcttgtttagaaagaatatcttttaaggcttctttttcctcttctgctaatgaagctacatagttataaaattcttcttcttgtttttctaattcctcttttgctgtttttaattctgcttttgcggaatttatttgtttttctttagtttcaagttctttttcgcttttatttagttcagcttttgcgtttgcaatttcgttttttaaagttgacttctgactttcaagttcatttttagaattagaaagtttagaagtgctgtttttaagtttctcttcggcactggataattcattgtaagcatcttttttcttttcgtccagctctttttgtgaatcgtttatttctttatatgctttgtctttttcttcttgtaacctttgagtttctcttaaagatgttgtttcttctattttatctttgtaatcagtaatgatttgttcatattcttcactaaaacaatttatatctttagttgattttaaacttacgtataagtcagtgtagtaatcgctgccaaaagtatccatacttaatattaagaatgtgtttattgttccgtctccaagttttgaagagccgtaatcatcatcagtaatgtaatatgaccagcttgctgttcctactatttttagttctttttctttaatttttacgctttcataatcttctacttttaaagtatctccgagttttaaattgtttgcttttaaataattatctgatattacacattcatttgattcttttggataacttccgcttataagttcataatccatcattacaatatcttctttgtttggcataccataagccttagctacaatgcttttgtcgttatgacctaaaagaagatctgttgaatatgtggcaaaaatatcttttgtgtctttatcgttttttatcgcttctatgtctttattactaaaaccatatgtggacataaaacttatatcgtacaagttggtgtcttcaaaatatttatttgccgtatactccatttgcggtcctattactcttagcccgacaaaaaagcacactccaagaagagtgattaataaaatggatataaatctattttttgtaagtctgatttctcttaataagtcttttattaatgtcttcatttaaggcaccttcatatgttgttatttaaaattctaccattctatgtcttcgacgtttttaacattttcgttaattataatatcttcaatttgtccgttttttacctttatgattttatttgccatttccgttaatgcaaggttgtgggttaccactattacgggaatattgttcataaagcaaatgtcttgaagtagttttaatattgattttcctgttttatagtcaagtgctcccgttggttcatcacataataatagtttaggattttttgcaagagctcttgctattgatactctttgttgttctccgccggataattgagacgggaaattatcggctcttttttttagccctacatctcttagagcatccaccgcggatatgcttgattttgatatttcagttgcaagttctatattttcttttgcagtaaggttttgaacaaggttataaaactgaaaaacaaagcctacatcgtatcttctgtatgaggtaagttctttttcgcttaatttgcttaagtctttgccatctacgattatgcttccttttgtgattgtgtccattcctccaaggagattaagaagtgttgtttttcctgcaccgctttgtcctactataatcgtaaatttgcctttttcgatttcaaagctaacgttatccaaagcttttacttcgttttctttgctgccgtaaattttactgacgttttgaataataatattatcagccatatcttttctcgctttcgtttatcctttgttttcaattaaaccttttcatttatattattatactatattattatgttttaacataataatatttgaaataactttgtgatgaaaagtagaaaataaaatatacctgtgctatactctaatatataaattttttagaggttattatgagacaaatagatactaaaattataaaagaagaagtaaaaaaacttatccttgaagcaaatgtttttcttggagatgatattaaaaatgctttgattgaaagtgaaaaagaagaaaagtcagagattggaagaggacttttaagtgttataaacgataatatagatattgcagcgaaagaaaactgccctatatgtcaagatacgggtatgtgccttgtgtttttggaggtaggtcaggaagttttctttacgggtaattacatttatgatgaaataaacgatgctataagagaagcttacgatgaaggatattttagaaaaagtgttgtaggttgtcctttaagaagagagaataccaaagataatactcctgggataatatattataacgtagtaaaaggtgataaagttaaaataaaagttatgccaaaaggttttggcagtgaaaactgcggtgatacaaagatgttaaagccagcagatggatatgaaggagttgttgattttatattacaaacagttgaaaaggcaggaagcaaaccatgtcctcctatgattgttggagttggaataggagggacaatggaaaaggctgcattaatggcaaaagaagctttacttcttgatattaatcacaaaaatgaagatgagttttatagaaatatggaagaagagcttattgataaaatcaataaacttggaataggtccgggaggacttgggggaagtactacagctcttggagtaaatattctaacttatcctactcatattgcaggactgcctgtaagtgttaatataggttgccatgtatcaagacataaggaaacggagatttaatatggaaaagaaagtaaaattaccacttagtgatgatgaaataatggatataaatgcaggggataaattatatttaacgggatatatttatactgcaagagatgctgctcataaaaaaatggtggaaacaatggaaaatggcgataagcttccttttaatataaaaggagagtgtatatattatgcaggtccatgtccagaaaaaccaggtgaagtaataggttcatgcggacctacaacatctgcaagaatggataaatatactccgtttttacttgaaagaggattaaagcttattataggaaaaggcgagcgaaacgacgaagtagaaaaaagtttaaaggataataatgctttatatcttgcggcagttggaggatgtggagctttaataaaaaaatgtataaaagaagctgagcttatagcttatccggagttgttatccgaagccgttagaaaattatatgtagaggatttccctgttattgtggcaatagattcaaaaggaaataatttatataaaacagaaaaagaaaaatataaaagacctttctaaaaaggtctttttttattaatcttctgatactcttacccctttattttaaggcgtttttattatataattgaaaggtaattaaattttggagaatggatatgtataagtatattgtttttgatttagatggaactcttattgatactgctgaggggacggtaaaaatgtttcaagaggggctaagatatgcaggaatcattgaagatgacaaagtagtaaaatctctaataggacctccctttgcaagaactcttgtaacaaaatatgggctaagcgaagaaaaagcaaaaaaagccatagatgtaagtaacgaatacatgtttgacaaaggcgtttatgaatgtaaactttttgatggaatgagggaaactttggaaatgcttaaagcgaataatataaaattatcagtagcgacaagccagcccgaagattccgcattgatagaagcaaaacatgtagaaatacttgattatttcgatcattttattgcaaataacctttatcagacaagaggaagcaaaagcgattttgttggaatgtgcattgataaaatggaagtatcagacaaaagcagtgcaattatgataggagataaaaaaccggatataatcggggggaaagaaaacggcattgctactatgggtgttttgtatggatatggtgatttgtctgagattaaagaaagtaatcctatacatattgtaaaaacaccgattcagattaaagatattattttaaaatagatttattatttttcttgacagtaataattacaatatattaaaattatattttaaggaaaagcaaaaaatagcaatattacaagctttttaatataaatttaggaatggagtaagatatggtttttgaagatttgaataaaaacagtgttaaagacatggaaaaagaaatatcaaattattgggaagatattgatattcttaaaaggtctcttgaaaccagagaaggctgtgaaaactttgtattctttgaaggtcctcctacagctaacggtagacctggaattcaccatgttattgcaagaacattaaaagacagcgtgtgcaaattcagaaacatgcaaggttacagagttaaaagaaaagcaggttgggatacacacggacttcctgttgaaattgaagttgaaaaaactttaaatatgaacggaaaaggtgatatcgaaaaatacggtattgcagaatttaataaaaaatgtaaagaaagtgtatttacttatgaagctctttggagagaaatgacaaagagaatggggtattttgtagaccttgataacccatatattacacttgataataactacattgaaacagtttggtggattttaaaagaattctttgatgcaggactaatttatgaaggtcataaaatcgttccttactgcccaagatgtggtacgggtcttgcttctcacgaagtagctcaaggatataaaaacattaaaacaaattctgtttatgttgcatttaaaataaaagataaagatgaatatttcttagtttggacaacaactccttggacacttccttcaaacgttgccctttgtgttggtgctgatattgattatgtaaaagtaaaatcaaaaggagtaactttcattcttgcaaaagcacttgctaatactgttcttggtgacgagtatgaagtaatcgaagaaatgaaaggtaaggaccttgaatatatcgaatatgaacaacttcttgactttgtaaaagttccaaacggcaagaaagcgcattatgtaatccttggagatttcgtttctactgaagatggtacaggaatcgttcatattgctcctgcttttggggaagacgactacaacgtatcaagaaaatacaatttacctgtattaaatcctgttggtgaagacggtaaattccttgaaactccatggaagggtacttttgttatagatgcagatttagatattattaaatatctaaaagagcatgatatgttatttaagaaacaaaaaattgaacataactatccacattgctggagatgtaaaactccattgttatactacggaaaaccaagttggtatattgaaatgacaaaacttagagatgaccttgttgcagcaaataatactgtaaaatggtatcctgaatttgttggtgaaaagagatttggtaactggattgaaaatgtaaaagactgggcaatttcaagaagtagatactggggtactcctcttaatatttggagatgtgaatgtggaaatattcacagtgtaggttcaagaaaacaacttgtagaagaagcaattgaagatatagatgaaagtatcgaacttcatagaccatatgttgacgatgttcatattaaatgtgataaatgcggtaagacaatgactagagtaacagacgttattgactgttggtttgactcaggttcaatgccttttgctcaacaacattatccatttgaaaataaagaagagtttgaagaacaattccctgcaaacttcatttgtgaaggtattgaccaaacaagaggatggttctattcacttcttgcaatatcaacattcctaatgaaaaaagctccttataagagtgttcttgtaaatgacttaattcttgatgctaacggtcaaaaaatgagtaaatcaaaaggaaacacagttgacccatttgatttatttgacagatacggcgccgatgcacttagatggtatttactatatgtatcacctgcatggactccaactaaatttgatgaagaaggattaaaagaagtaatttctaaattcttcaatacattaaaaaatgtttatacattctttgtaatgtatgcaaatacagataatgtagacccaagagaattctttgttgaatataaagacagagatgaaatagatttatggatattatctaaatacaataaccttgttaaagccgtaactgctgatatggaaattaatgaacatacaaaagcagttaagaaaatacaagattttgtaaatgaagatttatctaactggtatatcagaagatgtagaagaagattctgggcaagcgaacttgataatgacaaaaaagccgtatacaatacaacttacgaagtattaacaggcttaagcaaacttattgctccatttgctccatttatttctgaagaaatttacagaaaattaacaggtaaagaatcagttcatattgaaagatatcctgccatcaatgaagatttaatcgacgaaaagaatgaatttaaaatggatttagtcagaactcttgtttctcttggaagaagtgccagagaagaagcaaatatcaaagttagacaacctgtaaaagacattcttgtttatggtgctgataaagaagttatagcagggcttgttgatttaatcaaagaagagcttaacgtgaaagaagttacattccctgaaaaccttgaagaatacatgaactttattttaaaacttgactttaaagttgctggtaagattttaggtaaagatgttaagagagctgttgctgcattaaatagctgtgatgcaaaagcagtaattgacgaacttgataaaaatggtgaagtaacacttgatacacctgaaggtccattaatgcttaagaaagaatgggttgaaataagaacagaagcaaaagaaggcttcaatgttcaaaaacaagataatttattcgtaatcttagatacaaatcttgatgaagatttaatcaaagaaggttatgtaagagaagttatttcaaaagtccaacaaatgagaaaaaataatgattatgaagtaacagacagaattaacataacaattgattgtagcgatgtaatcaaaaattctattgaagaattcaaagcttatcttacaaaagaaactctttgcgatgaaattatctatgcagaaaatgacggtgctaatgttaaattaaacgatcaagaagcagtaataaaacttgaaagaaaatagaaaaaaaagactccttatggagtcttttttattaaaaaaaattatattttatcattaaagacttttaggtctttttttattttgacattttgtgaatgtcatataaaaacaaaatttatatataattttataaaaaaggttgttttttatagatataaaaatttgttgtgtttagtagttctttaataagtatattgttttatatagcatttttattagtttttataatcttttttacgacattctaatcattttgtgaattttgtaaaatgaaacaaaaaagtgtggctttggtatggaaataaattataaaacattgggattgaagataaaagaaaaaagaaaaaaattagggtatacacaagaaagtttatcagaaaaaattgatttgtctgtaagtcatttaagccacatagaaaatggaagtgcgaaagtttccctgcatgcaatagttaatattgccagtatattaaatttaagtttagatgagctttttagtattgatcttggtaataattttataagcgaaaatattaaggatattaatgagtttttaaaaaattgcagtaaagaagagaaaaagcttttatttgagaatctaaattttttaaaaaaagtaaatttaaaagagagtgaatatatttaataaaatgagcgaaagtattttaaatgaatttctatatttttattttgaaaataataaatgtgatgataatcaaaaaatgctaaatgaaattattgatttgtttgaaaaactaaataagaacattgataaaacatacagtgaaagcgttgaagaaatctttgaaaagatgcttagatataatcaaaaagaaaatgaatattgttttaaactgggatttaatatttgcatgagaatagttatagagatgtttagttttacataatacatattttgacaaatttcgcactttaataaatgtatcttttatcttgtaaaaaaatattaaggggataagataatggataaaaagtgtgccataacgggaataagggatgtgaaaaattttgatgaagagaaaaagacaatattgtttgaaaagataaaaaatataataggattactacatgtgaaatatgaaataaatacattttattgtggaatggctcttggtgcggatttgttatgtgccggagctattttagattataatgacagatttaatacaaatattaaaattattcccgttattccttataaaaatcaaactaaattatggaaacaagaagatattaaaaactataattacatattaaataactctttagatgcaataattctaaatgaaaaatatacaagaacttgcatgcttgaaagaaataggtatatggtagataacagtgagtttttgtttgccgtttatgacggaagagacagcggggggactagatacaccattgattatgcaataaaaaaagaaagaaaaataatttttatagatacgaagacttttaaattgtttaaaaatttttattaatggagatattttaatggtggaaaatattttatcaaagtgatactatatataaaaatgtaggaataaataatatagttaaatttttttaagaggtaaaatatgaagtacgattttgataaaataattgatagaagaaatacaaacagtgaaaaatatgatagtttaaaaagagcatatcctctttcagatgaaaataccatacctttatgggtggctgatatggatttcccttgtagtgatgcgataatcgcaagcataaaagaaaggcttttaaatcctgttcttggatatacttttgtttatgctgatgatgaatataaaagtgccgtttgtgactggatgaaggataaacatgattttataattgataaaaaagatatatattattccggcggtattgttcctgcaatgtgcgttttaataaacactttaacaaatgaaggagacagcattattgtaaatcagcctgtgtatactccttttatgaatatagtaaaatcaaattatagaaatcttgtaaattcaccacttataaaagatgaaaatggaaattatactcttgattttgatgattttgaaaaaaagataaaaaataataacgtaaaaatgtttcttttctgttcacctcataatccaataggtaaagtttggacaaaagatgaacttttaaaaataggtgaaatatgtaaaaaatataatgttatagtttttagtgatgagatacactgtgatattgtaagaaagggaataaaacatattcctattgcttcattatttgaagatgacgatatatttataacaggaacagcaccaagcaagacatttaatattcctggtatgaaggtaagtaatataattataaagaatgaagaatataagagtaaatggaaatattacacacaaaaaagacttcatgttgctgatcctaatgtatttgtaccggggcttgttaaggctgcatataaaaacagtgatgattggtataattatatgcttgaatacgtagaagaaaattttaaatacataaaaaaattcgttgatgaaaatttagaaaatgtaggttttgaaattcctcaggcgacattccttggctggcttgatatgaataagtacgatatagattatagtaaattatcagatttattcgtcacaaaaggcggttttgctattcagcacggtaaacagtttggagaagaagggataggttattttagaataaacgttgcaaccagcaggaaaaatatcgaaaaagcaatgaatgcaatgaaagaagtattaaaagatatacctataaaataaaaaaagaacatcataagatgttctttttatttttagtaatttttagctttaataaagaaatgagctcttggatggtcacatacaggacaaacttcaggagcttcttttgcaactactaagtgtccgcagtttccgcattcccaaacaacttcttcttctcttttaaatactcttcctttttggatgttttcgcataaagctctgtatctttcttcatgagctttttcgatttttgcaacaccttcaaaagtttcagctatatcatcaaagccttcttctcttgcttcttttgcgaatgtagcatacatgtctgtccattcgtaattttcgcctgctgctgcgtcaagaagattttcttctgttgttccgattccatgaattaatttaaaccaaagtttagcgtgttctttttcattgtttgctgtatcttcgaacaatgcggcaatttgattgtaaccgtctttttttgctttgcttgcgtagtaagtgtatttgtttcttgcttcgctttctcctgcaaatgcagtttttaagttttcaagtgtttttgttccgtctaatttattagccatataatttaccctcctatatgcgtttcttgttaaagtcattatatcacaaaaaaaatttttagtgtagaaaataaagaaaagtttagttaaatttaatatatttattattgctaaaaatttttataattatttgtaaattaaagaattttaataatcaaaaaaacgaatattttttattgacatatcttgtatatttttttataataatttgtgttgactataaacgtgataacccacggtagaggggagggttgagagatgtcagaagtaagattaagagaaggcgaatcactagaaagcgctttaaaaagatttaagaaaaagactgctatggctggtgttatgtctgaaatcagaaaaagagaacactatgaaaaacctagtgtaagaagaaagaaaaaagctgaagcagcaagaaagaaaaaaaataaaagataattaggaagtgttttatatgtcacttaaagaaactttacttggcgatttaaaaaaagccatgaaagaaaaagacaatataacaaaatctactgttactatggttagagctgcaatcttacaagttgaaaaagacaataaagttgaacttggcgatgaagaaattgtagatgtagttgctaaacaagtaaaacaaagaaaagattctcttgctgaatttgagaaagcgggaagagaagatcttatagctgaagcaaaagcagaacttgaagttctaatgagatatttaccaaagcagctgacaaaagatgaggttaaagaaatagtaaaagaagctattgaaaaaaccggagctgaaacggtaaaagatatgggcaaaatcatgggcgaagttatgcctaaagtaaaaggtaaggctgatggtaaaatcgttaatgaagttgccagagaattattaggctaatttaaggagtgtattacactccttatttttttactgtgaggtatatatgagcaaggaaaatataattgtatcggcatgtttgtttggagagaactgtaaatacagcggtggtaataatgaaatagaaaaagaaattatagagaaaatagaaaataaatataatgttatattatgttgtccggaatgtcttggaggactatctactccaagagagccaagcgagataagaaaaggaaaagtattttcaaaaagcggaaaagacgttactgaggaatataaaaaaggagcaatgatttgccttaatattgtaaaagaaaacaatgtaaaattagcattaatgaaagcaaattctccttcctgcggaaataaaaaaatatacgacggaagtttttcatctgttttgattgatggtaagggaataactgcaaagctttttgaagaaaatggaattgaagtaataagtgagaaagaacttgaaaagttattctaaatttgtatgaaaatgtttttaatgatactgagtattattaagagtaaaaaaagcatataaataataaaaaaagttaataaaatgaacaaaaaactatttactttataaccttaacagtttataatacaaaaatactttgaatatcaaagaactcaggaggaatataattatgttagaagatattaaaaaggtattagtagatgcgttagatattgacgaaagtcttatcacaccggaagcaagattaaaagaagatttagatatcgattctttagctgctgttgaattatcacttgaacttgaaacagaattcgatgttcaaatcgaagatgaagaattagaaaaacttgttactgtacaagatatcattgacattattaaagaaaaacaataatatcacttttttattcagtataatatttgggcttacgggcccttttatattacatttattcattatattttattttttatttattcggttttataggatattatagtttgaatatcaaagtattatttattgatttctttaaaattaattcaaaaggagaaaattttggatactaaagcaataaaacaagttatagatatttttgaaggctcaaatgttcataaaatggaaattgaagccggagaaatgaagattaaacttgaaaaagaagatagcaaaagtgttgtaaattatgttaaaccacaagaatatattgtggaatcacaaccagttataaaagaagatactgaagaagttataaaagaagaaccaaaagggaattgggtaaaaagtcctattgtaggaacattttattcaaaaccaaatgaaagttcacctgcttatgtaaacgtgggagacagtgtaaacaagggagatatcgtttgtatcattgaagcaatgaaagtaatgaacgaaataaaagctccttgcagtggaaaaatcataagtgttgcaaaacaagacggtgaaatggttcagtttgatgaaaatctaatatgtataggtgattaaatgataaagaaaattttaattgcaaacagaggagaaatagcagtaagaataataagaacttgtaaggaaatgggaattaaaaccgtaagtgtatattcaactgcggataaagatgccttacatgttcaaatagcagatgaagctgtttgtataggttcgcctaaagcaatggatagttatctaaatatgagtaatatcatagaagctgcttgtcagacaggatgtgatgccatacatccgggatttggttttttaagtgaaaatccaagatttgcaagacttgttattggatgtggattaatttttattggtccaaatcctgaaacaatcgaaaaactcggtaataagagtgaagcaagaaaaataatgatagaagctggggtgcctgttgttcccggttctaaagaaattataaaagatgtagatgaaggtaaaaagcttgcaaatgacataacatatcccgtaattattaaagccagtaatggcggcggcggaagaggcatgagaattgtaagaaaagaagaagaatttgaagatgcttttaatgctgctacaagtgaggcaaaggcttgttttggggatagtgatgtatatatagaaaaatacatagaaaagccaaaacacattgaaattcaacttatagccgataagcatggtaatgttatacatttatttgaaagagactgttctttccaaagaagaaaccaaaagcttatagaagaagcaccatgtcatatgcttaaagatgatataaggcagtctatgataaatgatgcaataaaagcatgtaaatatgttggatatgacagtgtaggaacaattgaattcttgcttgataaaagcggcaaatattattttatggaaatgaatacgagaattcaggttgaacatccaatatcagaaatgataagcggagttgatatagtaaaacaacaaattaaagttgcaggcggacaaaaacttactttaaaacaagaagatataaaacaaaatggttatgcaatagaatgcagaatcaatgcggaagatgtagaaagaaattttgcaccttccggaggaaagataaactttttacatattcccggaggaagaggaataagagttgacagtgctgtgtatacaggatatgaaatacctccgttttatgattctatgattttaaaactcattgcttttgcacctacaaggttagaatgcataaagaaaatgagagttgcattggaagagttaattatagacggagtaaaaacaaatatagaatttcattatttggtgcttcacaataaaacttttattgaaggaaaatacgatacgggattttttgaagagtttataaaggagttggaagaacaaagtggagaacttatttagaaaaagacaggaaagacttgaactttttaagtccagaagaataacttcttcgaaagaggttacaaaaagagaagttcctgaaaatttaataaaaaactgtgaagtatgccataaaaatactccatatgatgaaatgatggaaaatctttatgtctgtccaaattgcggtcatcatttaaagataagtgcaagagaaagaataagacaacttacggataaaagaagttttagggaaatggataaaaacattgaaagtaaaaatgaagataatttcccaggttattctaataaacttgataagttaaaaagagcaacaggacttcatgaagcagttgttaccggagttggaaaaataaacggtcaaagaattgccattgctgttatggacagtaattttatgatgggaagtatggggcaagttgttggagataaaattactagaataatagagcttgcaacgaaaagaaaacttccccttcttataagctgtaccagtggcggagcaagaatgcaagaagggattatgtctttgatgcaaatggcaaaaacaagtgctgcactaaagagattttctgatgaaggtggcttttatatctctttacttactcatcccactacaggtggcgtaagcgcatcatttgcgatgctaggagatataataattgctgaaccgaatgctcttgtaggctttgccggaaaaagagttattgaaaatacaatcaatgaaactcttccaaaagaattccaaagagctgagtttttacttgaaaaaggttttatagatatgattgtaaaaagaacagacatgaagaaaaccatttatgatcttatagtacttcataaaggagtaaaacaatgagcataaaagaatgtgaaattaaaatacgagaattggaagcaaaaaaggcttctctttctttaacggacaatgaagaatttgacaaaataaataaagaaataagacagctaaagaaaaaggcatatgcaaaattagagccttgggatagagtatatctagcaagacatcaagacagaccaaaagcaagcgattatatatcacttctttttgataatttttatgagcttcatggggatagatgttttggagatgatagtgcgttaattgggggtattggaacgtttaatgatattccggtaaccgttttggcacaggctaaaggaaaaactttagaagaaaatttaaagagaaactttggaatgatgaatcctgaaggttatagaaaggctttaagactggcaaaagaagcagaaaaattccatagacctattattacaatagttgatacggcaggtgcgtatccaggaaaaggtgctgaggaaagaggacaggctgaagctattgcaaaatgtctttatgagttttcaaatttgaaaactcctgttataagcgttgttatttccgaaggaggaagtggtggggctttggctttaagcgttgccgataaaataataatgcttgaaaatgcaatatattccgtactttctcctgaaggatttgcgagtattttgtggaaagacgaaagcagagccgaagaagcaagtaaatatatgaagcttacttcttttgatttgtatgaaaaaggaattgttgaccacataattaaagaacctgagggaggggctcaaaacggacttgagtatgtagttgctcaaatatccgtttatattcaaaatgagcttatggaattatcaaataaaaaagacagacaactaatcaaggaaagatatttaaaatatcgaaaaataggaatgatttaagatgaaaaatagaaaaattattggatacggttattacatacccaaaaatttaataacaaatcaagaccttgagaaaatcgtagatacaaatgacgaatggattaaaagcagatctggaatagaaacaaggtatataagcagtacggagaatacgagcgatattgcttacaatgctgccataaaggctattgaagatgcaaatatcgctaaagaagatatagacttaattatatgtgcaacatgtactcctgacaatatgaccccgtctactgcttgtttagttcaagaaaagcttggactaaatgattcacatgtaatggcttttgatttgaatgctgcttgtagcggttttttatattcaatgcaggttgcatcgtttatgttaagtgaatataaatgtgcattaattatcggagctgaaacattaagcaaggtaattgactggacagaaagaagtacctgtgttctctttggagacggagcaggagctgtaataatgaaaagagaacagaccgataatgatatgtacttttattctaacgcagaaggggataatcaagggaaattaagaatacaaggcttaagtttaaaacaaccacttcaaaatgaagaaagaaaagtaggtcatattgaaatggctggtaacgatgtttttagatttgcagtaagagccatgagtgatgctttaaaggaagctttaaacaaagcaggtaaatcaatagatgatattgacttagtaattccgcatcaggctaattataggattataaaacacgttataaaaaaacttaagatagatgaagataaagtatatattaacctaaataaatatggtaatacatcagcggcgagtgttgcaattgcacttgcagaagctaaggaaaaaggattaataaaagaaggagcaaaaattgttttgataggctttggagccggatttacatacgcttcagggtatattgaaatatagtaaaaaattatgacaatgttaaataaaattttaggtattaaatatcctattatccaaggtgccatggcaaacattgcaaccgcagaatttgcggcaagcgttagtaatgcaggcggtcttggtataattgccacaggggcaatgacttgcgaacaagcaagagaagaaataagaaaatgtaagaaattaacagataagccttttggggtaaatgtaatgatgatgaacccgcaaacagaagaaatcatgaatatgatatgcgaagaaaaggttgatgttgttacaacgggagcaggaaatcccggaaaatacattgagaaattgaaagaaagcggaacaaaagtatttcctatcactccaagtgttgctttagcaaaaagacttgaaagaagcggagttgatgcattaattgtagaaggtggagaatccggcggtcatgttggagaacaaacgactatgagccttgttcctcaagttgtagatgcggttaatattcctgttattgcggcaggtggtattgctgatggaagaggttttaacgctgcattatcattaggtgcaataggtgttcaaataggaacttgtcttcttgcaagcgaagagtgtcctattcatgaaaactataaaaatgcagttttaaaggcaaaagatacagaaacaatcgttacgggaaaaagcctcaatgctcctgtaagagttatgaagaataaaatgagcagagagtatgttaagcttgaagcccatgcaggaagcagggaagaacttgaaaaacttactttaggcgggcttagaagagccgtttttgaaggtgatatggtaacaggttcagtaatgatggggcaaattgccggaatggtaaaagagattttgcctttagaaaaaatattacaaaatattattgacgaatcaaaagaagagttagaaaaacttattgaaaaacacaaggagctataatgttaaaagaagtaaaaatcaaagataaaattttacaagtaccaatcattcaaggaggaatgggagtaggtatttctctatcttctttggcaggtaatgtaatgaaagaaggagcaatgggcgtaataagtgctgctcacccgggatataaaaaagaaggatttaataaaaattctctaaaatgtaatgtggaagcaatccttgaagaagtaaaaaaagcaagagaaataagcatgggaaaaggacttttaggtgtaaatattatggttgcaagcaaagattatgcacaatatgttaaagcagccgtaaaagcaaaagttgatgcaataatttccggtgcagggttacctcttgaacttccaaagcttgtagatgataagagtattttgttagctccaatcgtttcaagtggaagagctataagattaatacttaaaagatgggataaaagacataatacggttcctgattttgttgtgattgaaggaagtgaagccggcgggcatcttgggtttaaaaaggaagagcttttaaacggaacatgtgaaagtttagataaaatctttgatgacgtaaaaaaagagcttcaaccttttgaagaagcttatgacaaaaaaattcctgtatttgttgcaggaggcatatttacaggaagtgatattgctcattttataaaaaagggcgctgacggagtacaaatgggaacaaggtttattgcgacagcggaatgtgatgcagctaaagagtttaaggatatgataataaattgtaagaaagaagacattgcaattgtaaaaagtcctacaggtttccctggaagaggaataatgaactcttttatgaaaaaaacagaagaaagaggaaatatatctatgtcttcttgtttcaactgtttgtcactatgtaatccttccgatacaccttattgtatatcaggagctcttattgaagctgtaaaagggaatgtagataacggacttgtgtttgtgggcagtaatgcatacagagtaaatgaaatgactacggtacatgatttgataaacgagcttgtaagtgaagcaaatgaaaagttaaaggagaatgattaatgaaaataggatttttgtttgccggacaaggcagtcaaagtgtgggaatgggaaaagaattatatgatacatatgaagaagcaagagaagtttataatagtattagccttgattatgatgtaaaagatttatgttttaacggaccaaaagaacagcttgatgatactgcatattctcaaagtgctattcttacaacttctatggcaatagcaaatgttgtaaaatcaaaaggaataaaccctgattatgtatgcggactttctcttggagaatattctgctctttgttttagcggtgcttttagtgttaacgatgctgcaaacatagttagaaaaagaggagaaataatggcaaatgctcttcctaagggaacatcaaaaatggttgcagtaatgaattttgataaagatattataaaagaaacttgtgaagaagttaaaaaagaaggtatatgtgaaatagcaaattataactctcctgctcaaatcgttataacaggagaagtaaaagccgtagataaggcttgtgaaatattaaaggaaaaaggtgcaagaagacttattcctcttaatgtaagcggagcctttcattcatctttgcttgaagatgcttcggtaaaattaaataaagttttaggtgaatatgaaataaaaactcctgaaattcctgttgtttataatgttacgggaaaagaatacgatggtgacataagaaaaattttaacaaaacaaatcaaatcaagcgtgtatttcatgcaaatggttgaatatatgatagataacggagtagaggcttttgttgaaataggaccgggaaaagtattaaagggatttgtaagaaaaatcaataaaaatattccggtgtatagtgtggaagataaaaaatcacttgaagaaatgttaggagcattgaaataatggaaagaaaaacagcagttgtaacaggtgcaagcagaggaattggtaaagctattgctttagctcttgcaaaagaaggttttaatgtagttgttaattataacggtaacaaagaaaaggcagaacaagtaaaaaaagaatgtgaagattttggagttaacgcaataacagttaaagcaaatgttgctgattttagcgaaagcgaaaatttaataaaagaagcagtttcaacatttggaagtattgatgttttggtaaataattcaggaataacaaaagatacattacttcttagaatgaaagaagaagattttgacagtgtaatagatgttaatctaaaaggaacatttaataccataaaacacgcagcaagacaaatgatgaaacaaagaagcggaagcattataaatatgtcaagtgttgtaggaatatcaggaaacgcaggacaaattaattacgcagcaagcaaagcaggggtaatagggcttacaaaatctgtagcaagagaacttgcttcaagagggataagagcaaatgcagttgctcccggatttattgaaacagatatgacagatgagttaaatgataaagcaaaagaagaaattttaaaaacaattcctttaaacgatactggtaaaagtgaagatgttgcaaatttagttgtatttttagcatctgaaaaaagcagatatataacaggtcaagtaatccacgtagacggtggaatgttaatgtagtaggaggaaagatgaaaagaagagtagtaataagcggacttggtgcggtttcacctataggaaatgatgttgaaacaatgtggaactcaatcaaggaaggtaaatgtggtgttgatgaaataactcattttgatacaagtgattataaagtaaaattagctgcagaagtaaaagatttggatatggaaaaatatctaaaaagaagagaaattaaatttaatgatagatttacttcttttgcaagaattgcttcaatgcaagctatggaagatagcaaaattgatttggaaagtgttgataaaaatcgttttggtgttataattgccagcggtataggtggaattgaaactattgaaaacgctcaaaaaaatatggaaaaaagaggtccggcaaaggtttctccatattttattccgatgtgcttaattaatttagcagcgggcaatgttgcaattgattttggtttaaaaggtcattgttcttctactgttacagcttgtgcagcagcaagtaatgcaataggcgaagctttccataaaataagagacggatatgaagatttaatgcttgctggaggaagtgaagcttctattacacctcttgcaatggcaggttttatgtcaatgagagctttacatgaaggagacgataaggaaagagcaagtattccttttgataaagacagaagtggttttgttatgggcgaaggtgcaggtatattacttcttgaagaatatgaacatgcaaagaaaagaggcgcaaaaatatatgctgaaatcgtaggttatggtgcaacttgtgatgcattccatgtaacagctccaatttcagacggaagtggtggagcaggtgcaatggtaaatgctattgaggatgcaggcataaactataaagatattgattatattaatgcccatggaacaagcacacctttaaatgacaaaacagaaactttagctgtaaaaacagcgtttaaagatcatgcaaaagaacttaaaatatcttctacaaaatctaatacaggacatcttcttggtgcatcaggtgcaatagaagcaattatctctgtaaaagctttagaagatggatatattcctgcaacaataaattataaaaataaagatgaagactgtgatttaaacatagttccaaatgaaggaattaacgaagatattagttatgccatgagcaattctttgggatttggtggacacaatgtttctttaatatttaaaaaggcggaagaataataatgatatataattctaatgatatacaaaatataataccacatagatatccatttttacttgttgatacaatagaagaaataatagacgaaacttgtataataggcaagaaaaacgtaactgcaaatgaaatgcattttatggggcatttccctcaaaaacacgttatgcccggtgttttaatcgtcgaagccttagcacagacaggtgctgttttacttctttcaaaagaagaaaacaaaggtaaaattgcggttttagccggtgtaaacaagatgcgttttaaaagacaggttataccgggggatacgcttactttaaaggttgagctaacaagaatgaaggcaggcataggttttgccagtgcaacagcattagtaggtgatgaagttgcggcaaaaggagagattatgtttgctattgataaataaaagagaggttactctctttttttattgattataatgttgcattaaacttagttaggatatataatataaaacatgaaaaagagaaaagtaaaagtaattaaaaaaagaaaatcaactgaacctataaaaaaagataaaaaaagtattgttttatatttgttaatagcggtatttagtattactctgttattttctgcatataaaatatattcaattatgtctgaatataacaaaggaacttcaacctatgataatttaataagtgaagttaaaaaagataaagaaattgattttgatgctttgaaatcaataaatccagatgttgtaggttggatatattctgaaggtactgttattgattatcctgttgttcaaggaagcgataatgattattatttacatcatttatttgatggtacatcaaattcaagcggtactgtattccttgattatacaaagaataaagactttacatcgaaaaactctattttgtatgctcataatatgaaaaacggaagtatgtttgcaagtttaatggggtataaagatcaagaatattatgatgctcataaaaccatggatttatatactccggataaaaattatgaaatagaagtagtttatggatttgttattgatgcatacaaatgggatgataatggatttgcttcagatgataatgttgaagatttgcttcttcatgcaaaatcaaatacaacatttgacagcggtaagaccatatcttctgatgataagataataacactttctacatgttcatatgaaatagaagaaggaagatatgtattaatagggaaattagttgaaaaataaaaggtaagatttcttaccttttttttattttaataaaaaataaagattaaattaataaaaaggtattatatttatattatagttaaatatgatattttacatcattctacataaactttgtctgttttatgataaaacattttgtgtagcaatttataatattggaaaaagtatatttatgtggtaaaatatattcaaaattaggaggtttgtcatgagtggttttaatttagttgttccgagtaaaataatttttggtgaagggaaggttcatacattagataaatacatattggaatatggtgataaggttttattgttatgcggaaaagcttcattaaaaaactcagggatgttcgataaaataattggtaattttgaaacagataatataagttatgaaatacatacaataagcgatgaaccggatgttgaaacaatagataatcttgcaaatgaatacagaaataaacctgttgatctaatcgtaagtataggtggtggaagcgttattgatacaggtaaagctttgagtgcaatgttaaaagaagaaggaagtattgtagactatcttgaaggtgttggagataaagtcccaagcgggaaaaaagttccttttattgctgtgcctacaacaagcggtacaggtagtgaagctactaaaaatgctgttataaaaggacaaatcggggatgtgaaatttaaaaaatcaatcagacacgataatcttgttccaaacgtagctttggttgaccctgttttaactttaaattgttctaaaaaggtaacaatgcaaagcggtctagatgctttttgtcagcttcttgaagcatatatttgtacgaactctaatgcttttacggatatgcttgctgaaaaaggtcttagaagaatgagtgaaagtttgttaagtgcatataataacggtgaagatcttgatgcaagaaatgatgtatcttatgcagctttattatcaggtatatgtatggcaaatgcaggacttactacaatacatggttttgcatctgtaattggtggtttgtatgacggcattcctcacggtgcaatatgtgcaagcttacttcatggagcgactgttgttaatattcaaaagataaaagattttgagcctaacaatccttgtgcatataaatatgctaaacttggagcttatttaatgcgtgcaacatattctccggatagacatgaggtgtttttcagagctgttgttgacacattaaaagaatggaatgaaaaaatgaatattcctagactttctgattttggaattgataaagatgatttctggaaaattttggatgaagctaaacaaagaaataatccggttaaattatctgatagcgaaatggaacaaattttagatattagttattagaaaggaagattattatggcaagagtaactatttatacaaccaaaacatgtccttactgcaaaatggctaaggaacttttaaaacaaaaaggtattgattttgaagaaagaatgttagagttcggaagtgatgaacttatagagcttgtaaataaaacacatcatagaactgtgcctcaaattttctttggagaagaatttataggcggttatgatgatttacaaaaatatttaacaacaaaagaatttatttaaaaaagaaggcaaaagccttctttttaattgacagaaaattgcaatcgttttccttttcaaaattaaataaataaaaagaaaatatgtttttattcttgcaaatattatattttttccttattatagtcatgctataaacagacgtgtttgaaaggagaaaatatatgagggtatatttagataatgcggcgacaacaagaccttataatgaggttatagatataattaacgaatataatactgagtattatggcaatgcttcttctcttcactcttttggtagagaagcaagaaaaggaattgaatgggcaagagaagaaattgcaaatttgattaatgcatcagcaagagaaattttatttacaagcggtgctactgaaagtgataactgggccataagaggagcggcttatcacaatatagaaaaaggaaaacatataataacttctgcaattgagcaccatgctgttcttcatacttgtaaacaacttgaaaaagaaggttttgaagtaacttatcttcctgttgacagtgaaggtaacatcaatttaagagatttaaaagatgcaataagagaagatacaactctaataagcattatggctgcaaacaatgaaataggtacaattgaacctattaaggaaataggagaaattgcaagaaaaaaaggtatacttttccatacagatgcagttcaagccataggaaaaatggatatagatgttgaaaaaatgaatattgatatgctttcaatgtctgctcataaaatacacggaccaaaaggaataggatttttgtatataaataaaaaagtaagaattgatgtttttatgcaaggaggaggacaagaaagagctttaagagctggaacttataatgcaccttgcattgcaggaatgggtaaagccgttgaaataacaaaggcaaacatggaaaaaaatattccatatatgaaagaacttagagattattttatagatgaaatattaaaagatgtacctgatacaatattaaacggaagcagagaaaaaagattatgtaacaatattaattttacttttaaaggaattgaaggggaagcattgttatatgctcttgatttaaagggtatagcttgttcaacaggatctgcttgtacggctgattctggaagtgaatctcatgttatagatgctttaggagataataataagtttgaaataggtgcaagtgtaagattctctttaagtgaatttaatacaaaagaagaagtaaattacacaattgcagttttaaaagatacaataaataaattaagaaaattaagtccattttattaggaggtaaagaaaatgtataatgataaggtattagatcatttccaaaatccaagaaatgtaggagtaatagaagatgctactgtagtagcaaaagaagcaagcccatcttgtggggatacaacagaattttatttaaaaatagatgaaaatgatgttataacagatatcaaatttagaactttcggatgtgctgcagcaatagcaagtgcaagtatgtcaacagagcttttaaaaggcaaaacagtaaaagaagcaagagaaataacaaataagaaagttgttgaagaacttgggggacttcctcctgcaaaagttcattgttctgttttagcagaaggtgttataaataaagctttggatgaatatgaagaaatgaaaaagaacaaataaactttattgtaaatataatttatttatgatataattttaagaagaaaaaatatttttcggaggatagatatgaaacatattaaaaaagtgaacgaagttagagaagcaagcaaaaataaaggctgcggagaatgtgctacatcttgtcaatcagcatgcaagacttcttgtactgttggtaaccaaccttgtgaaaataaataaaaaaataaatagaataaaaaaagcaacctaaaggttgcctttttttaagttagaggaagatatgggtatatataaatataaatttaaagataaatatattgttttagatgtcaattcatctcttgtttatgatgtagatgaaatgacttatgatgttttagattattataaagataaaaatgaagaagaaattgttgctatcttaaaagataaatatgatgaaaatgaaataaaagaagtaataggtgaattaaaagaacttgaagaagaaaacagactttatacaccagaaaagaaagttaacagaaaattatttgaaaaaggcattgtaaaagcaatgtgtcttcatgtttctcacgattgtaatttagcttgtcgttactgttttgcttccggtggaaatttcaatatgaaaaaggaagtaatgagctttgaaactgcaaaaaaagcaattgattttattattaacaattcaggaaataaagttcatcttgaagttgacttttttgggggagaacctcttttaaactttgatgttgttaaaaagacagttgaatatgcaaaagaagaagctaaaaaatacggtaagatatttagatttacattaacaacaaactgcgttcttttaaatgatgaaattatagattatttaaataaagaaatgtataatgttgttttatcaattgacggaagaaaagaaatcaatgactttacaagacctactgcaaatggtaaaggaagttatgatttaataatagaaaatattaaaaaggttgctaaatcaagagatgaacttggtcttgattattacataagaggtacttatacaaaacataatttagatttctataaagatgttgaacatttttctgatcttggtttaaaacaactttctgttgaaagtgttgttgccgatgaaaaagaagattatgcaataacaaaagaagatttacctgaaattatggaaagctatgataaactaacagatatctatcttgaaagacttggaactgataaagaatttagatttttccactttaatgtagatttagatggtggaaaatgtgaatataagagagtttcaggttgtggtgcaggatgtgaatatgttgctgttactccttttggagatatttatccttgtcatcaatttgtaggtaacactgattttataatgggtaatttagatgaaggaattacaaacgataaattaagaactgaattttatgattcaaacagtgttcttgacaaaaaagagtgtgaaaactgtttctgtaaatatttctgtggcggaggttgtcacgcaaacagctacaactttaacggcagaataaacggtatttatgaaacaggatgtgacattttaagaaaaagaatagaatgtgctatttatattaagtgtaaagagaaagaacttattgactaggttataataacgttgtagaatatacaaatattaatatataggagaagatcatatatgaaaaaaaagaaaaacgggctaaagatgtttattattttagtcatagttgctttttgctattgtctctttatgttcgggcttcctttaagtaaagtaataggtatttatgacatagaacctttaaaagataccataaattatggacttgacttaacagggggagttaacgttgttttacaagccaaagaaagtaatggcaatgaagtaacaggcgaaactttagataaggcgattgaaacaatcagaacacgtatagattcattaggtgtaaaagaacctactatttcaaaacaaggaactgataagatcagagtatcaattcctgatgttgaagatcaagaagaagcattagcattaattggtaaaacagctaaattggaatttgttgatcctgacggaaatgttattcttgatggttcaaatgtaaaaagtgctaaatatgaaattcaaaaaagtgatggttatgtagaacaacctgttgttgctttagaattggatgatgaaggtgcaaaggcttttgcagaggctacagaaaaaaatattggtaatgtaatttcaatcaaattagatgatgaagttatttctgcgccaacagttcaaaatgcaattacagatggtaagtgtgtaataacaggtatgaaagattctgaggaagctacagagcttgcaactttaataacagccggttctcttcctgttgatttggaagctgttgaaataagaacagtaggacctacacttggtcaagattctttgacaaaaagtttaactgccggagttatcggtgtagcattggtattcttatttatgatagtaatgtatttacttcctggtgttgttgctgatatatctcttgcaatttatattattgtatatttgattttaatggcagggcttggagttactttaacgcttcctggtattgcaggtattattctttcaataggtatggctgttgacagtaacgttattatatttgaaagaatgaaagaagaattaagagccggcagaagtgtaagaggtgccattgatgcaggtttttcgagagctcttacttctattatagatgcaaacattacaactgtaatagccggattggttctatttttccttggtgccggaacaattaaaggttttgcgcttactttaatggttggggttgttgtaagtatgtttacggctgtatttgtaacaaagagattaatgatattatttaccgaatcaggtaaatttgatgatctaaaatttttcggaataaagagtgtgggaggtaatgaaaatgaattataattataaaattaattttgccaaacacgcaaaaagattccttactattgcaattgttttaatgttggtatcaatattttctttaatatttaaaggtttggattttggtattgactttaaaggcggtacaatcgtaacaattgagctaaataaaacatttaccactgatgaaataaagaatataactgataagtatgatcctaaagcggaaattacatcttctggggataatgcgactcaagttgtaataagtacaagtaaagatttaagtgattctgaaagaaaatctttatttaatgattttaaagctgagtataaattagataataaagacttattatctattgataatgtttcaggtacaatcggtgatgagctaaaatcaatggcaataaaagcttgtattattactgttatatgtatgcttatttacattacttttagatttgagtttttacaaggtttatgcgcagtatttgcgttaatatttgacttatgtatggttgttggagttttctcaatatttgatatacaggtaaattcaacatttattgccgcaacacttacaattttaggttattccataaatgatacaataataacctttgacagagttagagaaaatataataaaagtcgctaagggtgatttttataatttaacaaatatcagtattaatcagacaatgaggcgttcaatcaatactacacttacaacgcttcttgccgttactcctcttttaatatttggtacaacatcaataagagaatttgtatttcctatgatgattggatttatttcaggggtattttcttcaatttgtgttgctgttcctatgtggtatttgataaaagaatatcaaaagaagaaaaatccaaagagcgtaaatatgtcttctaaaaaagcaagtaaaccaattaatcaagatttattagatcctgattttaaaggtgcaagtgaatatagctatgatgctgattatgcaaaagactttgtaatggaagaaaaaagcgacgaagaacttttaagagagaaagaagaaagaaaagctaaaagaaaagctagaaaagaaagaaagaagaaaagaaaaaaaggacaaagataaaagaccacatatgtggtcttttttttatttatattttaaagctctaatggaatttaatattgcgattattgcaacacccacatctgcaaaaattgcttcccacatatttgccattccaaatgcgcctaaaatcattactcctatttttactgctaaggctataactatattttgttttactatagaaagtgtcttttttgaaattctgtagcctgtaataattttacttggttcatcagtcattataacaatatcgctggcttcaattgctgcgtcacttccaagaccgcccattgcaattcctatatctgccattgtaagaaccggagcatcgtttaaaccatctcctacaaatacgagtttgcctttttctgattttgtttgcatcaattctttaactttatttactttatcaattgggagtaagttggtataaacatcatcaattcctatttgatttgcaacatattctccaatttcttttttgtctccggtaagcattacggtctttttaatgcctaatttttttaaggattttatagtttcttttgagtcctcttttatttcatctaaaagtaggatataacctaaatattgtttttctttacttacatatagtacagttcctatacttttggtttcttctaactcaataccattttgtttcattaaatcgaagttaccaactaatatttcattttcatcaataacagcttttattccaaaacctgatagttcttctatattttctactctacttgtatcaatatgtttattatatgtttgtttaacagatattgccaaaggatgatttgaatatgcttctgcataagctgtaagctcaagcagttcttcctttttaatatcttttgcataaatttcttctactttaaaatgtccttttgtaagagttcctgttttatcaaaaaccattatttcagcttttgataatgcttctaaatagttacttccttttactaaaacaccactactgcttgcggctcctattccaccaaagaatccaagagggattgaaataacaagagcacaaggacaggatattacaagaaatattaaagctctataaatccaatcagaaaaaggtgtagatgttactattggaggaattaaagcaagtattaatgcacatgaaactactattggcgtataatacttagcaaaaacagaaataaaattttctgtatgggatttttcgctgcttgcgttttctataagttccaaaatttttgtagccgttgattcatcaaattcttttgtaacttttattttaagtattccgtttaggttaatacacccacttaagacttcatcgttttctcttacatctcttggtagagattcacctgtaagagcggaagtatcaagggttgatttaccactaagtataataccatcaagtggtattttttctcccggtttaactataatttcagctccaatatctaaatcatcaggatcaacttttattaattctccatctttttctatatttgcatagtcggggcatatatccataagttcacctatggattttcttgatttatttactgcataactttggaaccattctcctacttgatagaaaatcataacggcagatccttctgcatagtcacttaaaattatagagcctattgatgcaattgccattaaaaagttttcatcaaatacttttccctttgatatattttttattgcttttaagataatgtcataccctgataaaatatatgccagtagaaataaaacaggtgaaaaacttgtatttttaaatataaaaccgaaaacaaaaagcgttaaagcaatggtaattttgtatagttgcttttgttgtttgttcattcttttctccttaatttttaattatagaataatagcttcttcgtctatatctttaatagcaactcttgctttttcaattatttcttcaaaatcttcttcatttgcttccaatgttaatttttgaagcataaagtttatatttgcactttctactccatctatctttctaatagcttcttccattttcattgcacaatttgcacagtcaatgttatccattttaaatttctttttcatttcttttctccttttttatttttattcttctatgtgatcaattccttggtttaatatagtcataacatgttcatctgctaaggaataaaaaacggtttttccttcttttctgttttttataagtcttgcttgttttaaattttttaattgatgtgatactgctgattgagtcatatttaaaatattagcaatatcgcaaacacacatttcgctgacaagaagagcatttaatatcttaattcttgtactgtctccaaaaactttaaacagttctgcaaggttgtaaagttcttcttcgttcggcattttttcatgcactttatcaacaatatctttatgaatgtgttttaattcacacatttctatttttgctgctgccatagcatcctcctttacatatgaatatatgaatacttgttcatatatttaattatatatattttaattctgttgtcaatataaaataaaaaaaatataaatttatgcttgacttagagttgactttaagtcgtatattagaatatagaaaggatggtgtagatattgaaaataaaagaagcatcaatattaactgggatttcagaaaataatttaagatattatgagaaaatagggcttattccaaaaataaaaaaagatgaatcaggtataagagattacagtgaagaagatattagatggataaaatttatattaaaattcaaagaaacaggtgcaaaacttgaatacataaaggaatatatgcatcttgcacattcaaatgatgacacaaaggaaaaaagaaggaatattcttttgaatatagaaaatgaccttgaaacgcaaatagcacatttacaagattgtctaaatattgtaagatgcaaaattaaaaattttgatgatctttgtaatcctgaaacagaaaaaataattagtacaattaaagataattaaggggtatataaaatgaaaaaaaggtatttaggaaaaaataaacttgaagtttcttcaattggtcttggttgcatgggctttactcaaagttatcctccatatattacagatggcgaggctattgaagtaataagaaaagccgttgaccttgggataactttttttgatacagcagaagtttacggtccctatgaaaatgaaagtttacttggtaaagcattaaagccatatagagataaagtaaaaattgcaacgaaatttggatttgacatagaaaataatcgagttgatgagcttggcagacctgttgtgttatcaagtagtcccgattcgataaaaaaatcagttgaaggttctctaaaaagacttaatacggattacatagatttatattaccagcatagagtagatccaaagatagaaatcgaagaagtggcatatactataaatgaacttattaaagaaggtaaaatattgaattggggactttcagaagcgagcgttaacactataaaaagggcaaatacagtctgtccggtaacggcagtacaaagtgagtattctatgtggtatagagaacccgagaaagaactaatcccagctttaaaagagcttggtataggatttgttccattttcacctcttggtaaagcggtattaaccggaagatttaatgaaaatacaatatttgaaaaaaatgattttagaagtcaaataccaagatttaataaagagaatttgcccaaaaatattattttggtagattatgtaaaaaatattgccattaaaaaagaagctactcccgcacaggttgcacttggatggctattatcgaaagaagacttcattgttccaataccaggaacaaaaaaaatatcaagaattgaagaaaatataaaaggagaagatgtaattttttcggttgaagaaatgagagaaatagaaagagatttgaataatattgaaattacaggagcaagatacccaaaagaacaagaggaattaattgataaataatattctgctattacattcttaaatgtgataaaaatatgaattcaaatagaaaggaaccttaaaaaggataaattttcaaaatattcttgactttttattgtttatactttaatataaataaaaattgaatcaattataaaccatatagatgagagtaagtaattaaataattttattttacagagagtcggtggttggtgtaaaccgataaatatgtatttaatgaatggacttatcttgggcagtgaacaaatcatttatgagagtattcgctgacgggatcttcgcccgttataaaggaagcatatatgatagtatatgacaaagcggctttttagcaatttgggtggtaccgcaggaaattagtaatctaactcttgtcccttatgtttgggataagagttttttttataaataaggaaaaggagaaaaactatgaaagaacaaataccttacaaaatatatctaagtgaagaagagatgcctaaaaaatggtataacataaaagcggatatgaaagaacagcatgaacctttcttaaaccctgcaacaggtgaagctataacaaaagatgatttaagaccaatcttctgtgatgaattaatagatcaagaacttgatacaacaacaagattttttgatattccaaaagaaatacaagatttttataaaatgtatagaccttcacctttggtaagagcatattttttagaaagatacttggatactccggcacatatttattataaatatgaaggaacaaatacatcaggttcacataaattaaatacagctattgctcaaacatattatgcaaaaaaacaaggtgtaaaaggtcttacaaccgaaacgggagcaggtcaatgggggactgcaatgtcaatggcttgtgcatattttaatcttccattaaaagtgtttatggtaaaagtttctgctgagcaaaaaccatatagaaaggctgttattcaaacttacggaggagaagttattccttctccatcagacacaactaaaataggaagaaaaatcttagaagaaaatcctggaacaggtggaagtcttggatgtgctatttccgaagcaattgaagaagcggttaaaaatgattataaatatgttttaggttctgttcttgaccatgttgttttacatcaaagtattataggacttgaaaccaaaaaagctttagaaaaatatgatataactcctgatattgttataggttgtgccggaggcggttcaaatcttggtgggcttattggtatttttgcaggagaaaaaattcaaggtaaaaataatattcactttatcgctgttgagccacagtcttgtccatcaatgacaagaggaaaatatgcttatgatttctgtgatacaggtaaaacaacacctcttgcaaaaatgtatacattaggcagcggttttattccatctccaaatcatgcgggaggactaagatatcacggaatgagtcctattgtttcaaaactatatcatgatggaatacttgatgaagcaagaactgttgctcaaagtgaagtatttaaagcagcaactgaatttgccagagttgaaggaattcttccagcacctgaatcttcacatgctatcaaggttgcaatggatgaagctataaaatgtaaggaaacaggggaatcaaaaaatattgtatttggtttaacaggtacaggatactttgatatgagtgcatatatgcaatacaacgaaggaacaataatagatcctgaaattacagatgatattttacaaaagggttttgatactcttccaaaaattaaataattaaaaaagataaaagaaacgttttacgtttcttttatcttaaattaagaacaagttgactagagtctattgtttcgtctgttctgtattttattatcttatttaaagaaatttttatttgacttttattcccttctttattttctgtcgttatttcttttattattttattatctttatagtctgatatttttgctgtttctgcatcgacattatcaaatgttattataatttcttttttatcttttgaataattaattatatgtgtaggtattgtattagtttgttcaaaatcaataataactttagtatcgccgattaaatcattaatccatattttttgtattgatgtattttttgtgttttttccacctttaaaagtttcatttgttaaatagttacttttttcgtactttattttttgaaattgaatcatttattttatctattttatcagataaagaattattaaaataatttgataaatttatattattttcactatctggatgttctttaaacttatcaagtaaaattttatatctgacattgtttgtcatgttatcaagactcctaagtcctgagtatatcgtatcggcattatctgtatttaaaatattattttgagttttatattctttatctatcattactccaccgttttttcctttaacggtagtaataggaattcctgcattagataactccagtatatctctatttattgttctgattgaaacatttaatttttttgctaaagatgaaaccgtaactttatcttcttcaattaatgttataacaatactaacaagtctgtctattttcatatatgtaatattacctcttttatgtttactttatattatgatactacaaaaatataaaaaaacaaaaggaggcaagcctcctttaaattcatgtaaaactaaatatccacattcatagaacaaattgcaactccgcctgcatcttcgcatattattccttgtcttcccgctcttgaatacactcctgcaaattttccattataaaggaaaagtccgggcatattgttaaattcatcaaacacaaattccccacttttttcttttaagaaattctttgttttatacataggtgcgtattcttgaaggagatatcctttatttgtattttcatcaacaagtttttcaaattcttcctttgaataatcaactccggcatatactccccttgctccatataaatcatcaggttttattatccatttatccttattgtttacaacttcatctctgttaaattctccgtctttcaaccagcttgttgcaggaatgtgttctttaataaattgaatttcttcctctgttaaaaattcaaaagtttctttttgatgcataattttatatattatcttattatgtataacctgtgttcttattgaaccgattatacaagtctttttgtcttttatagcttcaataaaagcaggagctttatcgatcttttccataagttcgcttgttacggctcttctgtatacagcatcaatctttactccgtcttttgaatataatccgttatcatattttaacgttgttatatcttctattaaagtcttataaccttttttctcaaatctttgtttaaatattttaaactcttcattcgttgcactttccataaaatcaacaatagcaacagttgggttatctaccttatattcaaaatctgagtaaatattcataaattcatcaacccatgtatcgaaaagttcaaaatgtcttacattgtatctttcacaaaattttaaaaataatttgtcatctttataagcattgttaagttctctatcttcattcatggcacttgcaccgtcggcattaaactcacaaaacttaaaagaaaaatcatcttcattaaaaaataaatctattctcgctattggaagaggctgagaatatccattgtcacaaagaataagttcttcaagttcttttgaaaaagggaatagttttctgtaattctcatcttccatgtatttattaattattttgcaaagaatagtatgtgtagtttttgctacatattcaaaatactctattacttcatttgtataaagttttggaacatatggaaatcttattgggcttccatgataaatcgcagtagaagaatttatataatcaaaagccttattataattttcctttgaatattccaaatcttcatttattaaatctaaatattcctccgtaagttctcttactttcatcttactctcctctttcttttttcatttttaaagtaagtttgttttttgcaagctgataaaataaatcaacactttctttttcttcttcatgaagtttttcttttgcaacttctatcatttccattattatgtcagaagcatacattccataaactttagcttcatatccattttgtataatttcttcttttgcttttataacatcttcgtttcttacaaaactaaatttatctaaaaaatattttattgtttcttcattataaaatattccctttattattgccgcataagaaagagcataatacattggcatacaatctgccattcttatttccacataattcttaagccttacatcagggaaaaacatcgatattaaatgttctatatcctttttagttatttctctatttttatatatatcctttatttttttatcttttgtataaatactgttaccttgttcgtcttcaattaaaattgcaggagcatctaaaatatattttgcataatcttcaaatccaaaatcattatttaaagcatcttttacaaccatgcttctatctttgtctacatcattccatatttctaccctaatacaatttttcttatattcttctccctcaaatataaatgtattatctgtcattaaagaaattaaaggtgaaaaaatatttgcaagacggaacttatttttaaaatcctcttcactaaaataatcaacacttacttgagttgaagcagaacctttcatcatgttcttaccatggttacctaccgatgaaaaataatcaagcatatattcataacgttttttaggtattaaattaagattatcaactttcgacttaggttgatatcctgagtatacaagtttataatttagttcttttaaaatcggagttatgtttaaaagaaaataactgtattcttccaatatatcggctacttttataaaagggccaatgcttatttcaagctgacttgcaggctctaaggaaatatttgatttattcttcgaaagtccaataagattaccgtctttatataccttctcatcaaaaaatggacttaatttttcgagaatatatcttacaccatgttcttcataataatctacactttccatattctctttaacaataaaatgctcaagttcaacacctagagttttatcttctttttgttttattccatttttaaaatagtccacaaacttctttaaatttatgtcataataattcatagtgttaccttcttaatcttctttactctcttcaaattcactgtttattatttcttttgcaagctcataatcttctttatttacatatatattaacaggcattgcactttttccaattataacctttgctccgccaatatctgtgtcatattttaactttacttttatattgcaagaatcaagaagcccttctacaacacaggcttcaacatcgttatttacttccattaaaaacttcatattataattttcttttattttcatactaaatacctcggttttattataacctattgtaaaatttttacaaatatattttataataacacaattcaatagtttaaaaatatttttgacaataaataataaattttttataaatacccatattttgaataaaattttaaatgtattttaatattgaataataaatatttaaaatgtaaaataattatatcaaaataaatttaaagaggtaaattatgaaggtatctgtacttggatgtggtagatggggaacttttttaggttggtatagtgacaaaataggtcatgatgtaacaatatggggaagagaaaattccaataatttaaaagaattaataaatacaagaaaaaacaaatatttatatttaagtgaaaacacaaagctaacaaccaatttaaaagaagctgttgaaagtaatgagataattataatttcaatttcctcacaacaactaagaaatctattaaagaatataaaagaatttgattataaagataaaatttttattctttgtatgaaaggcatcgaaatagctacaggtgacagacttacgcaagttgtggaagaagttcttggcgaaaatacaaacgttgcagtatgggttggacctggacatgttcaaagttttgtaaaaagaattcctaattgtatggttatagacagcaaatgcgaagaaataacaaataaagtagttaaagaattttcaagcgacctaataagactttatataggagacgatttaatcggagatgaaataggagctgctgcaaaaaatgtaattggtatcgcagcgggcatgcttgatgctgtgggatacgcttcactaaaaggtgcattaatggcaagaggagcaagagaagtttcaagactgataaaggctatgggaggacgagaaatcactgcttatggactttgtcacctgggagactatgaagcaacactgttcagcgaattctcaaacaacagaaaatacggagaaaacttcgtaaaaggcacaaatagtgacaactatcttgcagaaggagtgacaacagcagaggcacttgttaaattaagcaaaaaatataatatagatatgccaataacctccggagtaaatgccgttctcaaagaagaagtaaatcctcataaaatgttaaaagatatgtttctcagaagcgtaaaaaaagaattttattaaaatatttgtataaaacaaataatcaaatctacaataaaaacatatcggttttaaataaacaacaaaccgatatgttttatattaccaacattatttctatttaattaacatagcatatagagcaattcattcttaaaaatgaaaagtttccaatgctttttccaactcactaaaatcgtttttgtctgtagtaaaaagtatataaacaacattatctccgttttgtatcgcataatatcttgaataagtagaataaccttctcccatatcatcttcatactcaatcattatagcttctctatcatcaatatttaaatctatcttattttttatttcaacactttctttttgaaaagatatccaattatcaatattattttctatattatctttatattcgtttgtatcaaaataaaaataataatttttgtttatatcctgactgtttgaaaaagaagttccgccagaattataatccatctcataatcttcccattctttaggtatttgcatatatgcactgtcagttactttcagctctttacctaatgtattgtcgtttttaaaaaacataccccataacataaccatagatattaaaagcgcaataataaaagcacacactgttataataatcaaaggttttttgttaaatgatttttttgactcaataccgaataattcttcctctcttctcttttcctcttcttcttgacgtctttgctctttcaatatttttttttcttttcttgaaatatccatgtcattttccccttttatgttataaaatataaaattaaatttttaaaaacactaacatcccagaaaatttttatgaaaaactatttggtttttaaataatttataagtccgccgtttttaagtaacattctttctctgtctgatacaataagtcttaatttatattctttatttttagtttcatttttaattatgacttcatctgtatcaagttgctttaatacatcttttgcacttaaaacgtcatcaatgtctatagtatcataatcagcctcatctataaatgttaaaggaacgataccgttgttgattaaattatttttatgaattcttgcaaatgattttgctataacaacttttacaccaaggtataaaggcgctagagcagcatgttctctacttgaaccttgtccgtagttatctcctgcaacgataattgaacctttttcttctgcttttgcttttgtagcaaagttttcatcaacaggtcttaagcagaattcacttaaatattcaatatttgatctaaatggaagaagtttagcatttgaaggcataatatcatcagttgtaatattatcaccaagttttgttactgcttttaattcaaaatcattatatataacgcttgctttagggaaaggtttaatatttggaccttttacactgactttgtttttatcaggttttggcataataaacatattatcgttgataatatattcacttggttcttcaacaacaaagtcaatttttccgtaaggatcggcaatttcaccttttattgcagaataagcagcaacttcaggagatacaaggtatacatttgcatctacagtcccacttctacctttaaagtttctgttaaatgttcttagagataccccgccagagttagggctttgtcccataccaatacaaggaccacaaccacattcaagtattcttgcacctgcatttattaaatcagaaagtccgccgtctcttgaaagcatatcaagaacttgtcttgaaccaggagctattgtaagagatacgttatctgcaattgtttttcccttaagtattttagctgctgtcattaaatcttcataagaagagtttgtacaacttccgattgatacttgagttatttttgttccttcaagctcttttacgctttttacattatctggtgaatgaggacaagcagcaagaggttttagttcgcttaaattaatttcaagattttcatcatattcacagccttcatcagcacataaaggtttataatcttcttctctgtgttgtgctttaaaaaatttaagagttacttcgtctgaagggaaaattgatgttgtagcaccaagttccgcacccatatttgtaatagagcctctttgtgatactgttagagatttaactccttcaccatagtattctataactttaccaactccaccttttacagaaagtcttcttaaaacttcaagaattacgtcttttgcactaacgcctttatcaagttttcctgtaagttttacccctacaactttaggcattgttagataatattcacttcctgccatagctgctgcaatatcaagaccaccggcgccaatagcaatcatacctacaccaccgcaagtaggagtatgagagtctgaaccaagaagtgtttcacctggcatagaaaatctttcaaggttaagtctatgacatattccatttccgggacgagaataaataaccccgattttatctgttactgtttgaatatatatatggtcatccatattttcaggacctgtttgaagcatattatggtcaatataagcaacagaacgttttgtctttactttatcatcacttattgcttcatattgtaaataagccattgttccagttgagtcttgagtaagtgtattatctattcttattgaaataccttctccggctaccatgttcccacttacaagatgactttcaagtattttatatgtaagagtctttttcataaatttatctccttaaaatttcatttaatctatattatcaaaaaaatttggaattttcaataaataatagaaatatataaacatgaaaacgtatatttatgcaaaaataataaaataataattatatataatagggatttttaaatgagaatttatttttatataagataccatatgtataaaaattaatatatgtaattataaatttataaaataaaacaagtatatatattatttataaataagtttcttaaaaatatcttatttttaaactacttatattttaaataagatttgtttaaaatataatgaataattaaaaaaaggaagtttgtcatgattaggctaaatttaaagtatttactacaaaaagaaaacaaaacaagatattggttaatgaagcagttaaacagtaactacacaactgtaaacaaactcgttgaaaacgagactacaaaaattactttcgatatgcttgaaagactgttaaaagtatttgactgcaaaattgaagatttgttaatcgatgatgaagaaaacaaaaacgaataaaaaactccttatggagtttttttatttactgtaagatatcaacatcttttaaaaatcgtttaaacatgctataataaaccatcaaaacatatatgaggaaagaatatgaaagatttaaaaaattatttatttgaaaatattttaccttacgtagaaaaaccatcaagatatatcggagatgaatttaacagcgaaaagccaaaggaaaatcctgcggttagatttgctttttgtttccctgatatatatgaaataggaatgtcacaccttggaatgaaaatactttatgaagtattaaataatatggatgatgtaatgtgtgaaagagtatttgctccaaacatggacatggttaaccttatgagagaacacaacttcccattatatactttggaaagtttctcaaaagtatcagacagtgattttgtaggttttacaatacaatttgaaatgtgccttacaacagttctgttaatgcttgatcttgcagggattccattccttgcaaaagacagaactgaagatgatcctcttgttgtttgcggaggtccttgcacatgtaatccagaaccatttgcagacttttttgatttgatgatgcttggagaaggagaagaagtattacctcacttaatggaattatataagaattcttcttcaaaaaaagatttccttataaaagccagtgaagttacgggagtatatattccaaaccttaaagaaataaaacaagaaaaagtagaaaaatctattattgaaagtatgaacaacgtatacacaataaaaaaaccggttgttccatacactccggcagtacatgacagaataacacttgaagtgatgcgtggatgtttcagaggatgtagattttgccaagcaggaatgatatatcgtcccgtaagacaaaaatctctagaaaacttacaaaaggaagcaaaagctttaatagaaaatacagggtatgaagaaatgtctctttcaagccttagcacaacagaccattttcattgtatggatttaataaaacatcttgtttcaacttataaagataagaaagtaaatatttctcttccatctcttagaatggatcaattctctcttgaattatctgaagaacttggaaatcaaaagaaaggttctcttacttttgcccctgaagcaggaagccaaagaatgagaaatataataaataaaaacttaaccgaagaagaaatcttatcaacaataaaacaagtatttgaaacaggatactcaaaaataaaactttattttatgataggcctaccatacgaaacagatgaagatataaaaggtattgcagaccttgcacaaaaaataattgatgtatattacagcatagataaaaagaaaagagcaaaaccatttaaacttactgtaagcacatcgtgttttgttccaaaaccttttacggcatttcagtggttccctcaaaacacaatggaagaatttcacagaaaacaacaatatctaaaatctgtaatgccaaagcaagtaacatataattatcatgacagtaagctttcaatgcttgaagcagtgcttgcaaagggagacaggagcttgtcacaggcgataataaacgcatataataacggatgtgtatttgactcatggtttgatcatttcaactatgaaggctggataaaagccttaaaagagatgggaatagatgcacaggaatatgcatcaagaaagcttagttatgaagatgaacttccttgggataaattcgattatcatgtagataaagaattcttaataagggaaaatgaaaaagcaaaaaaagaaaccacaaccccgccttgtcataaacaatgctcggcttgtgggataagcaaagcatatgggaggtgtaaatttgaagtatagacttaaatatataaaagtagataatctcgtttttatatctcatcttgatatactaaatgtagtacaaagatcatttagaagagcaggaatggatcttgaacattcaaaaggttttaaccctcatccaaaagtacactttgccccaccgctgcctttatttacatcttctaagggagaatatatggatgttgaaactaaagaagattatgaaactaatgaactaatggaaagattaaacaatgctcttcctgataatcttcaaataataaaggcagaaaaacttgaagaaggttcaaaaacactcgggaaagttcttgacagtgccatatatcaaataaaaatatatataagtgaagaaaataataatcttgatgataaaataaatgactttataaaaaattccattgaattaaatataacaaaaataaataaaaaaggaagagaagtaacaagagacataaaaccaaatatatttgattttacatgtgaacaagaaaataatgtattaatcataaacactactctttctttaagaataaatgaaattttatcaccaaatgatttattaaaacttttaagagaaaactttgaagaaattgaaaaagcaaacaaagtaaagttggaaaaaaaagatacaatactatttccaaactaaaatatgtatgctataataaattgaatatgtgaaaaataataggttacaaaatatatggaggtatataatttatgatttcagcaggcgattttagaaatggtgtaacatttgaaatggacggagacgtatttacaattgttcaatttcaacatgtaaaaccaggaaaaggaagcgctttcgtaagagcaaaaataaaaaacattaaaacaggttcaactgtagaaaaaacattttcaccaaacgaaaaatatccaaaagcagaaattacaacaaaagaaatgcaatatttatacaacgatggtgaattatactatttcatggatggtgaaacttttgaccaaattccacttaactacgaccaagtagcagatgctattatctacttaaaagaaaatgataatgctacaatcagattccatgcgggagaagctttcagcgtggcacctccattatttgttgaattagaaataactcaaacagaacctggttttaaaggtgatacagctcaaggtgcaacaaaacctgcaactgtagaaacaggcgctcaagttaacgttcctttattcgttgaagaaggagatatcatcagaatcgatacaagaactggtgaatacatggaaagagttaaatagtaaaaaatataagaccgcaatatgcggtcttttttaattaaagaaattaccatttaaagataataaaaaacaatttacttgattttatagacctttttagatattattaataagtaaataattaggagtggtatcgaagtggtcataacgggattgattggaaatcaattgtactcttatcggggtaccgtgggttcgaatcccacccactccgccataatttataagccttagagctttttttatttatcataaaaacataagaaaagactgttaagaattcttaacagtcttttttatttttataaatatataaacttcctattgccattaaagatattaaaagcaaagtaacataagctataacattattctcatctgatgtattaactaaagaagctgttgtcttatcgtttctatcaccgtttgagataatataatcagggtcttcgtatccacaaacactgcatttcccgtttacataattatgagcttcaaatacagcagtaattataacatcactatttggcattgtaaatgtagtttctacttcatttatattagaaaaaacaatatcgtttccgctcgttatgctccatgaagtaaaatgtccgttcttattattatcatttgcttttatgcttactatttcaccttctccaaaattaccgcttccacttccattttcaacggttaatttatatattcctttgattatatctttataattgatccagtcatttgaacttttatattcttcaaccaaagcagaaggaacataaataacagaaagactattacaattataaaaaatatcatctccaatagatacaggagtttcactcaataaataaacctttttaagcaaagtacaattttcaaatgcatatctttctattgatgtaacattctttggaattgttatttcacttaaagaactacatccatcaaaagtatatttactaattgatgtcactccatccggtatgtttatatttgttaatgaagagcagtcttcaaaagcgtactctcctattgatgttacattatttggaattgttatttcctttaaggaactgcatccttcaaaggcagaacttcctatttttgttactttatccggaatgattacttcacttaatgaactgcattctctaaatagataactgctgattgatgttactccacctggtatatttacctttgttaataaagtacagcctgaaaatacagaacttcctaatgttgttacagtatctggaatggttatttcacttaaagatctacatcctttaaaggcagacccattaattgatgtaattccatctgacatagttaccttgcttaatgaataacaatcttcaaaggcagaacttcctattgttgtcacactgcttggaattactatttcacttaatgatttacacccatcaaatgtataattattaattgatgtcactccatccggtatgtttatatttgttaatgaatagcaatttttaaatgcaaatgtacctattgatgttacactatctggtatatttatttcttctagtgcttcgcatgattgaaatgcataatcgcctattttcgttacattacctaaaatgtttactttacttaaggctttacactcaaaaaatgcataattactaatagaggttacccccttaggtattgttatttcatttaataagatacacccttgaaatgcactttcctcaatagaggttacattttcaggtattgttatttcacttaaagctctacacccgaaaaatgataaagtacctattgatgtcacgctatccggtatggttatttcacttaatgagtagcatttgtaaaatgtattttcgtttattctacttactccgttaggtatatttattttagttaatgaagagcagtttgcaaatgcatttgtctcaatcgatgttacactatctggtatggttatttcagttaatgcctcacataactgaaaagtactgtctttgattgatgttaaattattagataatgttacgttttcaagtccataacaatatttaaacacccatcctcccattgaagttacactgtctggaattactatttcctttaacgcttcacaactttcaaaagcagagtctccaatatgtgtaagagtgtttggaagttctatatttgttaatgaggaacaagcataaaaaccttgactatcgatttcggtaatcgcatactctgttccattcccgtctcttatttctcccgttaaatcaagagttgtaaaacttcctttttgatttgctcctatggttaaactatttccgtcagccgttacattatttattactaattgagtattttcactgtttgttaatgtttggttttgtgcattatacgtccagtcgtctgatgcagcaaagctttcctttggaataaaaaggaatataaaggcaaaacatatagcaagcatacataaacatttgagtaatttcttcttcatggctttctcctttaattttaacgttataattattttatcatatttactaatcatttgtatactacccattttttattaaaaatgggcaaaaatatataccatttaaaatttaataattatttctaataaaataatttaataaaaggttataaattaaaatgtatttctacaaaaaaaaagagcttataaaagctcttttttattgtttttttcttctgttaaattcttttaatggaatagtgcttccgtcttctctttcaacaacaatattatcaacggtatttttgaaatttcttcttatattaccaagataaattttatatagctcctgttgttcttttaattcttcttcactaagaccaacagttttcttcttttttgctagttcatttattctatcaatttgttttttatccattattcttcctcatcaacaacttcaataccaagttcttcaagttgttcttcacttacgatacttggagcatctgacattaagcaagagtggttttgagttttagggaatgcaataacgtctcttatgttttctgttccaactaaaagcatgatcattctatctaaaccaaatgctaatccaccatgtggaggtgttccgtattttaaagcttttaacaagaaaccgaatttattttcagcttcttcatcagagaaaccaagaacattgaatactctttgttgtacatcacctgaatggattctgatacttcctccacccatttcaactccatttactacaaggtcataagcttttgctcttacacttgcaggatcactttcaagtttatcaagatcttcatccataggagctgtgaaaggatgatgcattgctttaaatctcttttcattttcatcatattcaaacattgggaagtttgtaacccataagaaattgaatccttcatccattttcacatctgcttttttagcaatatgaagtcttaagtttcctaaagaatcgtaaacaaccttatttttatctgcaacgataaatacgatatctccgttttctgctttagctctttctaaaataccatttgtttcttcttcacttaagaattttgtaatttgagatttaattgaaccgtcttcatttacagcaatccaagcaagaccttttgcaccatatgttttaacataatcaactaatgcgtcaatatctcttctagagaagaaacttgcaagaccttttgcatttattgctcttacgcttccgccatttttgattggacctgcaaatacattaaatttacaatcttttaataggtcacttaaatcaaaaagttccattccaaatcttgtatcaggtttatcagaaccaaatctatccattgcttcttgatattccattctcataataggagtttcaatatcataatcaattatgtctttgaaaatctttttaacaagtctttcgtttacgtcaattacatcatcaacatcaacaaaactcatttcaaggtcaatttgagtaaattccggttgtctgtcttgtcttaagtcttcatctctaaagcatttaactatttgataatatctatccattcctgcaaccattaaaatttgtttaaataattgaggtgattgaggaagaccaaagaatttaccttttcttactctacttggaacaaggaagtcccttgcaccttctggtgtaggttttccaaggaaaggagtttcaatttccaaaaatccttcactatctaagaaatttcttacaacagaacatgtttttgctcttgtaataagattattttttattttatcttttctaaggtctaagaatctatattcaagtcttgttgcttcatttgcattatctgtttcatcaatgtaaataggtggtgtatttgctgtatcaagaacttccattgtatcaagtttaagctcaagttcacctgtttcaatatttggattgaagttttcttcatctcttaaaacaacttcccctgttactttaagtacatattcatttctaatgtgttctgctttttcaaatacttctttattaagttcactgtttgcaactaattgcataataccgcttctgtctcttaaatgaatgaaaataacccctccaaggtctcttcttctttgtacccatcctgcaagggtaactgttttacctaaatcttcttttgttatttcagcacacatacatgttctataacttgtttttctcttcatcttactctcctaatttttcttttatatattcaaataaattttctatattaacttcttcttgttctttagagcgcatatctcttagagtataaactcctttttgaagttcatcttcacctaaaattgcagtatattttgtattaactttatttgcatatttcatttgagcctttaaacttctatccataacatcaatacttgctttaataccgctatctgtaagtttcttaaatgtcttaaaagcaacttttgaagcttcttttccaacaggagccaaatatacatcaatctcatcatcttctaagtcatttaaaagtccttgttcttccataataagcattaatctttcaagaccaagcccaaatccaactccgggagtatcaggaccgcctatcatcttaacaagaccgttatatcttcctccgccgcatactgttccttgtgagcctaaatcggtagaaacaaactcaaaagccgtttgagtgtaataatcaagtcctcttactattttaggatctacaacaaactcaatttcagcatttgaaagataatcttttacactttcaaaatgttcattacattcttcacataaataatcaaccattaaaggtgcatctttaagaagtgttttgcaatgttcgtttttacagtctaaaattctcattggatttttattaagtctatccctgcagtcttcacaaagttcattttcaaatggttttacatattcttttaacttttcataatatgcgcttctgcattttggacagcctacactgtttattctaagttctaagccttttattccaagtttattaaataaagtacttacaagcattattacttcagcatccatacttgcagaatatgagcctattgcttcaataccaaattgatggaattgtctttgtcttcctttttgaggtctttcacttctaaaacacgatgtaatgtaatatagttttgtaggtgtaatcccgcttgacataccatgttcaatataagctcttattactgaacttgttccttctggtttaagagcaaatacatcttttcctctatgatttagcgtatacatttctttacttacaatgtcagtgctttctcctacccctctgtcaaaaagtgcataatgttcaaaatcaggcactctaatttgcttatagttaaatgttttgcatatttcttttattttaccttcaaccatttcccatgcttttacttcatcaggtaaaaggtctcttgttcctttaggtgcaaatatcttacttcccattttatttccctttctatataaaataagcccctgacataaaaattatgtcagggacgagaattcatttcccgcggtgccaccccaattggtataatacccgctttttattaaattgttaagcgtatgtgtaagttgtttttcaaagtaacagagcataaaaaatgcttccagtcacggcattttctccctgatatgatgttaaatctactcttcttaccgcttataatcaagtatttctattataattttattaagccctattgtcaacaaataagattaaaaatatacagttattttatattttttatttataacttttaaaacttcatttaataattatcaaaatcttttctattttatatattacataaattttatatttttttattatatatttaaacgtttaaatgcaaatatgatataattaaaaaaataataaagggggaaattattatgccagaagtaaacgaagttttaatatggacatttgcggcagaatgccctatgcctgcagatgtacaagaattacttgtagaaggagaacagccggtagctgcatataaaacaataagagacagcgctatttttacaacaaaaagacttattgtaagagatgctcaagggcttaaagggaaaaaagtagaaatatattctcttccttatacatcaatagaaatgtggagtacagaaaacgctggaggatttttagacgctacagccgaagttgaatcatggacaaaagttggacatataaaagtaaacttaagaaaaggtgtggacataagaaaatttgacaaattaatatcaaatgctattctaaaataatttttttatgtttattgacaatattttattataatgataatatttaataaaataataaatagcaggggagcttacgcgtaggctgagaaaaaaaacgatcgaattttgacccttaacgtcgtatggataatgccatgatatgtatgctcataacactgtaaattttaagcttatccatttggataagctttttttattaaaggagagaaaaatgaattacacaacacaaatggatgcggcaaaaaaaggtatcattacaaaagaaatggaaatcgtcgcaaaaaaagaacatatggatattgacaaattggttaagcttgtggctgagggaaaagttataatcccatgcaataaaaaccacaagtgcattgacccaaacggtgtaggttctatgcttacaacaaaaatcaatgtaaatcttggagtatcgagagactttaaagatatggaccttgaagttgaaaaagtaaacaatgctgtaaaaatgggtgcagaatcaatcatggacttatcttcttatggagatacaagaaaattcagaagaagacttacaagtgaatgccctgcaatgataggaactgtgccaatttacgatgcggttgtatactatcataaacctcttataaaaattactgcaaaagaatggcttgatattgtaagaatgcatgcagaagacggtgttgactttatgacaatacactgcggaattaataaagaaacaataactaaatttaaaagaaacaaaagacttacaaatatcgtatcaagaggtggttcaatcatctttgcatggatggaaatgacaggagaagaaaacccattctatgaatattatgatgaagttttagatatttgtagagaatatgatgtaactatgagtcttggtgatgcttgccgtccaggttcaatagcagacggaacagacgcagctcaaatcgaagaacttataactcttggagaacttacaaaaagagcatgggaaaaagatgttcaagtaatgattgaaggccctggacatatgcctctaaaccaaatagcagcaaatatggaaatacaaaaaacactttgtcacggtgcacctttctatgtactaggacctatagtaaccgacgtagctcctggatatgaccatataacatctgcaatcggtggagcaatcgcggctacatacggagcaagtttcctttgctacgtaacccctgcagaacatttaagacttcctaacttagatgatgttaaagaaggaatcatcgcaacaaaaattgcagctcacgcagctgatattgcaaagggcgttcctcatgcagctgactgggataacgaaatgagtacagcaagaaagaaacttgattgggagaaaatgtttgaactttgtatggatcctgaaaaagcaagaagatacagagaagaatcaaagccggaaaaagaagatacatgttcaatgtgcggtaacttctgtgcagttaaaaatacaaacagaattttggaaggcgaaatcgtaagtatctttgatgaataaaatgaataaaaaaaaagacagtttaaaaactgtcttttttattgtcttttttatttaatttttctttttacatatactaataaacctaaaatacaaacacttgcagaacaaagaattgcactccataagaataattgattgttgtcacttgtttgaggatttaatgttgtattagttgtttcatttaaattatcatcaacagatccagtgtttgatgaaacacttttatcattatatcctaaagcgtatgttgagaatttagaagtactaaaagtaattacatcatcttttgttacagaatccaatttttcagcaacaccatcatgtattctaacaatgaagaattctctaccttctttaagtaaatcttgaggaattactatgttaaaatctgcagatttatttaaattatttatctttccaattatttcattatctgcttttattacaattgacaaatcaaaatattgtccaattaaatctttttcgtctaatgtactttcaactaattctttttcctcagccgtagcatttattttatcatcaacaactacctcaactgaaatatctgctccatcagatattgcactttctaattttttaacagtatctttatctatagaagtaatcttatcagaatcgccgttttctattttatttacaatatctgaaattgtatctaatacgatattcgtatcatttttatctattcctatttgcatattttgagatggtttagatgtatctatagaaggagattctatttgtattttctcattacatatactacaaactccatctatataattatgacctgtagctggtattgtaacatcgctttttgttgtttcttttgtacaatttttatctaaaaaatatttatctaaagcttctatataccaatattccttatttccatcttgtgtgcaattagcaacttttgcagggaaatgttgtaacttatatacattataagtattaccatctttaaaagaaattgcatcttcagctaaaaagttttttgtcggattttccgttaaactatttgaaggatcaaaattttcaaatgttccacctttaactgtgattgatgcatttgaattatcaataagatttagatgccaatatgttccactatacattacatctgctttaaatgtccctccatttattataacagaagaatcactccctgcttgtacacatgtaagacctgcatgatatacattatcttcaagaacaactttactgtttccatctactcttatagcataacctaaagagtaattactattcatatatccactattttcatctgaattatatgttattgtcccattacctttaattgtaacatctgcactaccatatatatcaataagacctgcatcttcagtatctttaatcgcatcataagttaatgtataaccatttaaatctaatgtaacattattatctattttcaaagatttatataatgttatattattacttaatacaacctctccacctttttcaacagcatctatcaattcatcttgtgtagatacattcgttgcagcaaaaacacccgaaggtaacattgccattaccattagcatggcaacaagtacagaaaaaatttttttctttaacatttaaatatcctcccttttttttatcgggaagattttctgcgccccttcccgtattaatacctttcttttatataaaaaggtatatttttgtaactatgaaaataaatatatattagtatttctcttataattttataaattcattacataaaaccaaatctttatattgtattttctgtagctacaaaagtcttatttcatttatatcatatttttacgaaatattcaagattattatccttttttttacattaattatatataaaaattaaaaaaaatttacataattttatttaaattatttttttataatataaaaaaacaacaaaaatatatattacagaaaaaactatccttatttgtatacctaaatataatcgtattataatacagtaatattattttaatcaaataattcttttgcataatataccgactgcattgcatctttaccgtaaaaatcagcatttatcatatctgcgtattcttgatttaaaacagcgcctccaaccattaccctgcactttggacttttttctcttaacaatttaattgtttcctccatgcttacaactgttgttgtcattaaggcagaaagcccaacaagtttaacatcttcttttacagccgtttctacaattatttcaggatctacatcttttcctaaatctattacatcaaaattataattttcaagaagaacttttaatatatttttacctatatcgtgtatatctccttttactgttgcaataactattttttcttttttctcttcttctttgccttcttttaaaatctcgtcttttattatttcaaatgcagcttttgccgcatccgcactcattaatagctgaggtaaaaacaaagttcctttttcaaatctcttaccaaccttatcaagtgcaggaacaagatattcatttattatattcaaaggctctttttcatttagaagattttttgttccttttacagcttcttcttttaatcccttttctattgcattttttaatgaaattatttcttcttttgatactttttcttcttttttagtatctgaatatttttttatataattttcaaaattctcatcatgattcatcaaagcacaaaaaccataataagaacgcatcatgtcttctgaaagtggatttattatcccaagatcaagcccgctttgcattgccattgtataaaaatttgaatttattataggtcttaaaggaagcccaaaagaaatattagaaacacccagtactgtcttaactccaagttcttctttaacaccttttaatgcctctaatgtggttatggctcctcttggatcggaacttatagtcattgccaaaacgtctattacaatatctttcttatctattccatatttttttgcttcattaattatttttcttgcaatttcaactcttccccttgcatcattcggtattccattttcatcaagagtaagcccaataacgactcctccatatttttttacaagaggaaaaatctcatccattgattcttgttttccatttaccgaatttatcataggtttaccattatagattctcattgattgttcaagtgcatttgtatttactgtatcaatttgcagcggaaggctagtaacactttgtaattcaaaaataacttttttcatcatttcaacttcatctatatcaggaagacctacatttacatccaaaatatcggctccggcatcttgctgcaaaagagcttcttttaatatataatctaaatcgttggatttcagcgcttcttttagtctctttttccccgttgggtttattctttctccaataattattggtttagtgcctatttctactgcatgtccataagaagaaacaatagtgcgttcatttttctttctttttacaagatttctatctttattattctctaccatttcttttatatggctaggtgtagtcccacaacagccaccaatcacacaagcacctaactgaacaatttctttcattatctcgccaaattcttcttttgttacatcataataaacattaccgtctttttgttttggtagtccagcattaggttttacgataacaggaattgaagcatactctaaaatttctttaagtagtggtatcatttgtttaggaccaagcccacagttaataccaagtgcatcaacccctaaaccttcaagcattgaaacaacacaagggatatctccacctgttaataatttacctttttcatcaaaaataacagttgcaaatacaggaagagaagtacattcttttgctgcaagcacagctgcttttaattcataagtatctcccattgtttcaatatgaattaaatccgctccactatcttgacctatttgaacaacttgagaataaactttataagcatcttcaaagcttaaatctcccataggttttaaaagtttaccggtaggcccaatatctaaacctacataaacttctctattatcttttactcctagttttattgcttcttttacatttgaaatcccaaaacgtactattttctccaaatcgtacttattatctttaaatttaagcgcatttgcaccaaatgtattacttaaaactatgtcacttccagcctcaaaataacttctatgaatatctattatttcttctctatgctctatattccatatttcaggaagttcaccgggtttcaatcctctttcttgaagcattgtccccattcctccgtcaaggaataacaactcttttcccaaacgttccaataacataaaattactcctttatttttctaaattcacaatcttttttattacaagttttacaccctctgtccatacaaacatttttatcttttcctataccaataactgcagtaacagattttgaaggggttaacatgtagccttgcgtcattgtaagacctattgttttcgcactatctaacattctaagaagcatttgttgatgacatatatcaaaatccccatacccaggactaaatcttggttttaaatatcttttttctctttcatattctatttctttctctttttgccacttgtctaaatactcctcaagaatagccgcagcacaagcttgtaaaactacagcttttgacatttgagtattagaataacgtcttataagaaaatctacctgtatacccagagtagctcctataactataacttcatcacaacctgataagtttttcattaaattattactttttatttgcatttgtccaatacttatatattcattatgaaaacttaaattaaaattacggtatataattttttttgatacgattccatttaattcttctaaagattcttctattaaatgtaaagtttcattatctacaatattatttttatacccaagatatcttatggtttcttttgttattatatccattaatattcctaacctttaattatataagataaattttccataatagccttagcaacttccggtttattcattgagtatacatgaatattattaataccatttgcaattaaatcaataatttgatcagttgcataggctataccggcttgttgcattgcttttggattatcgccaaacttatcaacgattgcaagaaaacgctgaggaagtactgttccggaaagttcgcatattctcttcatctgttttccgtttgttacaggcattattccgggtaaaacaggaattgttattcccttttctcttattctgtataaaaaattatatagtatattgttatcaaaaaacatctgagtagtaagaaaatccactccacagtctactttatgtttaagattgtctatatcatcttttttatgctccatttccacatgtccttcaggataacaagccgcacctatacaaaaatctccgctttttcttatatcttcaataagttcgcttgcataatgataatgatttggaagaggaaaattactatcctttgggatatcacctctaagggcaagaatattgtctataccttcatgttttaatgttttaagtattccctttatagtttctttggtagatgatacacacgttaaatgagcaagacttatcacattcatttctctttgtatttttgaagcaatatttatagtattcttgcttgttcccccacctgcaccatatgttacacttataaacgaaggatgaagttttgcaatttcatctactgcattcataacatcttcaatgcctgcatctgttttaggaggaaaaatttcaaaagagatatgaggtgtatttttagaaagagtatcttttattttcatatttttctcctatatattttataaaattaataaataaaaagcgatatgataacataccgctttattcaacaagttattttattcaaaaatagatactacactaccatcatatttttcatcaataaaatttttaactgtatctgattgaagagctttaagtaaagcttttgttttgtcagtttcttcgtttcctgcttttacgcaaagaatgttagcatatgttttagcagcttcactgtcagctgtttcaattgcgatagcatctttatttacgcttaaaccagcttccattgcatagttaccgttaattacagcaaagtcaacatcttgtaaactctttggaatttgagcagcttctaattcttgaatttttacattgtgaggattgctttcaatatctttagctgttgcatttaatccagcatcttttttaagtgtgattacaccatttttttcaagaagaagtaatgctcttgcttcatttgttgtatcgtttggaactgctattgttgcaccatcaggaatattttttaaatctttagattttccaggataaatcccaagaggttcatagtgaactgttcccacagatacaagatttgtaccttgttcttcattgaaagaatccatgtatggtttatgttggaagaagtttgcatccaaagaaccatcttcaacggctttgtttggttgtacataatcagtaaattctgtaatttctagtgtatagccttcttttgctaaatcttctttaactgcatttaaaatttctgcatgaggaactgctgttgctcctactttaataactttgtcatctgaacttgaactacttccgcatccagcaaataagccgaatactaaagccccggttaataataccgcaaataattttttcatatcttttctcccttttctttttaattttatattcttttatcaatcttccttgcaataattgttcccattgcctgaagaacttgaactattaaaactaacaatacaacggtaataatcattattgttgattcatatctgtaatatccgtaacgtattgctatatcaccaagtccaccgcctcctacaaaaccagcaagagcagagtaactaagtatggttgttatagaaattgaaaatcctaccattaaagaaggcattgcttctttaattaaaacctttgttactatttggtaaactgatgcacccattgaaagtgaggcttctataacccctctatcaacctccttaagtgaagattcaaccattcttgcaataaatggtgccgctcctataacaagaggaacgattgttgctgttgaacctattgttgttccaacgattaatcttgtaaaaggaattaaaactacaagtaaaatcaaaaacggaacacttcttaaaacatttgtaacaacgtcaagtatcttaaatataaccttgttttcttttattcctccttttgcggaagttacaagcaacactcccattggaagacctataatatatcctaaaaatgtggaaacaatggtcatatatagtgtttgaagaataccgacacctatcatttgccattcagcactgcctaacatattaatcttccatcctttccactactaaatttttaccttcaagatattccataacttttcttttctcttcttcgtcttttggaatttctataacaatttgtccaagagcttttccttctatatcttttacgtttgcataaagaatagaaaccttaactcctgtatctaaaatcatgtttgatataaccggttcatgtgttgtgcttccgtcaaatacaattctaagagaattattcttcaaatcttgactcatttttttactgtcaggattaattgtatttttagcccagttactttttggatgtgtgaatatttcttcaacacttcctgtttctgtaatcattgaattttcgattacagcaacatgagtacaaatttcttcaacaacactcatttcatgagttattataactattgttataccaagttttttatttatgtccttaagcaaatccaaaattgactttgttgtattcgggtcaagagctgatgttgcttcgtcacaaagtaacacttccggatttgatgcaagagctcttgctattgcaactctttgtttttgaccaccacttaattttgcaggataagcattttctttttcacttaaacctaccatttcaagaagttctaaagctctcttctttgcatcctctttttttactcctacaatttcaagaggaaacataacattttttattactgtttcttgcatcaaaagattaaattgttgaaaaatcattccaacatgatgtcttgtttctctaagttctttatcacttaactttgataaatctttacctgaaatataaactcttccttttgtaggtttttcaagatagtttatacatcttacaagggtactttttcctgcaccactcataccaattattccatatatatcacctttgtttatttcaaggttaatatcttttaaggcatttacttctccgtctttggaataaaaagtcttatgtaagttttcgatttttataatcggactattatttttttctaactccatatcttccaattcctcatttttttattaaatacgcgctatattataccataaaatttttcaattttattttaaaaataaaaaaaccttatcggtaatttcttatagtataacacaactttttattatatgataattcttgttttttatatcttgttatagctaaaagttatataataaaaaaacgccttttggcgttttaatattctataaacttatttgctattttccctattgcctttttttctattctcgaaacatacgaccttgaaatattatacttcttagctatttctctttgtgtataatttttacttccttttaagccatatcttaaatatataatttccttttctcttttagttaaaacttcatctataatattatataacctttcactttctacttttaaatttactttagaattaacatcatcttcatcggttgacaaaatatctataagggatatattatttccctcttcatcaaaacttatgtaatcttctaagaaaacatttgatgatattttgctttcacttctaagtgccattaatatttcattatctatgcaccttgatgcatatgtcgcaaactttgttcctttgccataatcgaaagaatttattcctttaatgagacctattattccaatggaaataaggtcgtcttttggaatatttgatgaagaatattttttacttacatgtgctactaaccttaaattatgattaataagtttttcttttgcttctttattgttctcttccttaaactgtttgaaatacttaagctcctcatcttttttaagcggttttggaaaagattcatttgaagataaataaccaagaaaaacaaggacttgttgaagtaaatcaagaatacctaaaaatcctaacataaaaaatcacccccataaaatatatgagggtaaaaaataaatttgcttgtacttttatatatatttttttatctccatccattcatctaaaagcatctcaagagaatatcttgcatttgcaggacttgtggaaggtaattttttatagcttatatcaatatccttattatattttttataaagattaaaagctgttcctccatttaaaaatatattttttatttttgaattatcaataataacttttaaatcatttgccttaacattttttattgaactgtcagaagaacctacaatatcacaagactctattacatcaaaaacagctatatgactatttaataacatttctttcttttcttttacagttttaggaagtggataatttgtaatagtacttataaccttccaaaacctgttttgaggatgtgcataaaagaattcctcttcccttgactttacagaagggaaagaacctaaaataagtatttttgaatctttattatatacaggttttatattatgaaattccattttaactccttaaatcaatcaaaataaactctttgtctgtcaggatgttctcctgaccatcctatttgaggaagacacattaaataatacatatcgtctctttcaatactaaaatcaaatatatctaaattttctttcattctacatatagatgaagattttattattggcattattcctaattgatataaaaatctaatacaaagctgtggcactgttttaccatatttctctgccatttcttttaatgattcttcatttaaaactcttcccctgccaagaggtgaccacgcctgaaccaagatatcatttttaacacaaaaatccaatgcggttttttgtaaataacctatatgtaactctatctgatttaccataggttttatctcacaggtatccattaaatttataagatggtgtggaagatagttacttacgcctattactttaatacgacctaatttatataattcttccattgctttccaagtttctatattcttttgtttccaatttatatcgttaggattttcttttggccaatgaattaaataaacatctaaataatcggtatttaattcttttaatgatttctcaaaggctttcattgtttcatcatatccaaggtcttctctccatacttttgaagctattattaaatcttctctttttacgtttgagttttttatcgcttttgcaatatcactttcatttttgtaaaaagcagcagtatcaaagtaagtatatcccgaatttattgcatcaataactgccttttcacagtttccatttcctgctttataggttccaaatccaatttttggtattgtaattgcgtttgttaatttaaagttttccattttcctctccctttaataacaccttttacaaggagcaagtcctttttcctttgcttcttttaaagtaattttttctgcatttttcatatttgaacaatctgctttagaatgatatttacttccagactttgaaatataaacatatgttttttcttcgctggaatcattggcattattataattaacatcttcttttacatcttcacttttttctttactattctcatcaataacttttatgtttatttcattactttgtattttactatttttagaaattatttttaaaattgcatttccttcttcataactttttatataaaatttatccgcctgtttatatatagtggcaacatcttcatttgaagaataaaactttatatcatctttgaaaaaagtatcaggtgaaatatccacatttatttgataagtagaattaatattcattttttttacattggaagacatttttatcgagttaatttttggagtaaaaataacaaaaatattaattacaaaacataccaaaatacataaaataatcaatatacttctcttgttttttaatttattatcatcatcgcttttctttaaataaaaatatagaaatactacaagaggtatccatgaaaatggaaatattaatattaaaaataaaatgccaagcatcataaacaatttaattttattatttattttcatttttttatccttatgattttatatacattattttactacaaaaaataaaaatacaataaaaaaactatggattattccatagttttttcatcatttaaaatcttcataaattcttcacctgtaattgtttcatgttcatataaatattttgcgatttcatgaagtttcataatattgtcgttaaggattccttttgctttttcatattgtttattaattacttcaacgacttttttgtcaatttctcttgctgtttcgtttgaacaagcaagggaagtatctccaccaagatacatattgttttgtgtctctaaagcaaccataccaaattcttcactcataccaaatcttgtaatcatcgctcttgcaagctttgttgcttgttcgatatcatttgaagcaccggttgttattgaattaaatataatctcttcactggctcttccacctgtaaaagttgcaattttattttcaagttcttctttgctcattaagttatgttctccctcatcaacttgaagtgtataaccaagagcccctgaagttcttggtattatagtgatttttgttacaggagcagaatttgtttgtttcgcagcaacaagtgcatgccctacttcatggtaagcaacaataagtttttctttgtcagaaagtactttattctttttttgatatcctgcaattacagtttcaatactttcttccaagtcttgttgtgtaacttcgcttcttccgtttctaaccgcatgaagtgcagcttcatttattatgtttgcaagttctgccccgcttgcacctgcagcggttcttgcaataacttcaaaatcaacattttttgctatcttgatatttttagcatgaactttaagtatcgcttccctgccttttaaatctggaagctcaacaggaattcttctatcaaatcttccgggtcttaatagtgcaggatcaagagagtcaggtctgtttgatgctgccaatatgattacaccttttgaagaatcaaaaccgtccatttctgtaagcaactgattaagagtctgttctctttcatcattaccgcctatattggcatttcctcttttctttcctatagtatctatttcatcgatgaacactatgcaaggagccttttcatttgcctgtttaaacaaatctcttacttttgcagcacccatacctacaaacatttctacaaattccgaaccggaaattgagaaaaatggtacgtttgcttcacctgccacagctttggcaagaagtgttttacctgttccaggaggccctacaagtaatgcgccctttggaatcttcgctccgatttgttggtatctgccgggattatgtagaaaatctactatctctgttaaagcttcttttgcttcatcttctcccgcaacatccttaaattttactccgtcagttgacttaacgtatacttttgcattgctttttccaaactgcattggaccaaatccaccggaacccattcgttttgtcatttttttatttataaaactaaagaatactgtaaatattattattggcaatataaaccaaataaagaagttagaaaaagcagaattttgttctacaatttcactaccaaactttgcaccactttcttgtaatctttgaacaagttgagtatcagaacttatgatacctgttttataaatatgctttggttcagacttatctgtaaataatattttatttgatgtaatttctacttcgtcaatttgtttttcttcagtcatagtaataaatgtactgtaatcaacttctttaatctgttttgcacttaaagaaggaattacaaacatattcattaaaataatgaagataagtattgcaccataaatttttaaagtacgttttgttccattatccatttttttcataattttctcctgttatctataatttatatataatattttcacataaaattttaagaagtctttcaagctcagatatttcttcatctgataataaactttttatatgctcttctatttcattttttttcgcatacattttttcttccgaatctgttactttttttgtaagaataatatttcttttccttttatccttttcacttcttttaattatgattaaatcttttgattgtagtctttttaatatacctattactgttggatgagaaaggttaaaatgtttttcaatatccttttgatatatttcttcattttttctttcacataaaaactgtaaaacttccatttgggagaaagtcaaatctaattctttaagttcattgtttacataagatattagtgcgtcatttattcttttaaaataaaattctaagttttcttctttcataatcttccctttttatgtaatatgctacatattttaatctaatgtatgaataaagtcaataattctaaagaattctaatgtaattttaattgacaaacaaaatataacttaatataatatatttagattgtgattaccacaagaaggggtacaccaccgcgggtgtagattcttcttgtggtattttttttacgaaaaaggaggaaatatgataaagataaacggtcaagacacaaaattatctgatatttctttaaaagaactgctggaaaaatgcaattttgatagtgaaaaagtagcagtggaacttaatgaagaaataataagcaaaaaagattttgataagatcaaaataaaagacaacgacaaaatagaagtagtaagttttgtaggaggaggctgatgaataaagtacctaaaaaagaagaaataaaccaaataatagatataagattttcaaatgaaatacatgaaaagctaaaaaacgcaaaagtcgcagtggcaggacttggaggacttggttcaaatatagccgtaatgcttgcaagaagcggaatagaaaatattcatatagtcgatttcgacaaagtagacttaagcaatttaaacagacaaaattattatataaaacaccttggcatgaaaaaaacaaaagcgacaatagatatattaaaagaagtaaatccatatttaaatattaaagctgacgatataaagataaacgaaacaaatgcagcacaaatatttaaagatgacgatataatatgtgaagcttttgacgatgcaaaaaataaagctatgctaataactgctattctaagtgaatataaagacaaaaaaattatttcaggaaacggtatggctggatttgacagttcaaacttaataaaaactacaaaaaaaatgaaaaccttatatatttgcggtgatgagaaaagcgatataaataatggtatcggacttatggcgccaagagtaaacatatgtgcagcacatcaagcaaacatggcaataagacttattttaggaaaagaagaagtgtaaaggagaaaaacaatgcaaaacaaagaagacaaacttataatcggaggaaaagaattttcttcaagatttatcctaggttcaggaaaatacgacttaaacttaattgatgcggcaattaaatatgccgacgcacaaataataacccttgctttaagaagagcaaacactgtaaaaggagaaaatattcttgattttattccaaaaggagtaacccttctaccaaacacatcaggagcaagaaacgcaaaagaagccgtaagaatagcaaagcttgcaagagaacttggatgtggagactttattaaaatagaagttatacatgaatcaaaatatcttttacctgataattacgaaacaataaaagcaacagaagagttagcaaaagaaggatttattgtaatgccttatatgtatcctgacttaaacgcagcaagggatatggtaaatgcaggagcagcatgtgtaatgccattagcatcccctattggttcaaacaaaggactttctacaaaagaatttataagagtacttataaacgaaatagatgttccggtaatagttgatgcaggtcttggaagaccaagtgaagcttgtgaagtaatggaaatgggagcagatgcggtaatggtaaatactgcagtagcaacagcaaaagatattcctctaatggcaaaagcatttaaagatgcaataaatgccggcagaaatgcttatcttgcaggtcttggaagagttatagaagacggagcagtttcatcttctccgctaacaggatttttaagagactaaggaggcagaaatgaaaagcatcgaagaaatgagaaaagtaagtcatatggaatatatggaagatatggaacaaataccttcagacattatggataaagtaataaacgaaatagaaaatacaaattttgatatatatacaaaagaagatgtaataagagctttaaacaaagacgaaaaatcaatagaagattttaaggctttattatcccctgaagctctgcctttccttgaagacatggcaaaagctgctacaaaagaaacaagaaaacattttgggaactcaatatatctttttactcctctttatatatcaaactactgtgaaaactattgtatatactgtggatttaactgctacaataaaattaagagagcaaaacttccatatgaagatattgaaaaagaaatggaagcaataagtaaaacaggtatagaagaaatacttatactaacaggcgaaagcagaaaaatgtctgatgttgaatacataggtaaagcctgcgaaatagcaaaaaaatactttaaaaacgtaggtattgaagtttatcctatgaatagcgatgaatacaaatacttacacgaacacggtgcagattttgtaacggtattccaagaaacatacaattcagataaatatgaaacacttcatttaatggggcataaaagaattttcccttatagatttaatgcacaggaaagagccttaatgggtggaatgagaggagttgcctttgcggcattgcttggtcttgatgattttagaaaagacgctcttgcaacaggacttcatgcatattatctacaaagaaaatatcctcatgcagaaatatctttctcatgtcctagacttagacctataataaacaacgacaaaataaatccaaaagacgtacacgaaccacaacttcttcaagttatgtgtgcatatagattatttatgccttttgcaggactaactatctcaacaagagaaagagcaggatttagggataatgttcttggaatgtgtgcaacaaaaatatcggcaggagtaagtacgggaattggaagtcatactgatgaagtagaagaagaaggagacgaccaatttgaaatcagcgatgctagaactcttgatgaagttttagacgcaattaaaaatagaggtcttcaacccgtaatgaatgattatgtatacttatcataatttaatatgtatcacaaacagacatttatgcaatatagatttttataagagaatagaacaaatatgtaaaaaaaatcctaaagctatagttttaagggaaaaagacttaaaagaagatgaatataaaatacttgctatggaagtaataaaaatatgtgataaatacagcacagatataatacttcataatttcattgatacagcaatatccttaaatcaaaagaaaatacatcttcctctttggaaagcaaaagaggaaaaagaaaagcttaaatattttgatgttattggaatttcaacacacagcactaatgaagcaatagaagctaaaaatcttggcgcaacctatataacagcaggacatatttttgaaacggactgtaaaaaaggtcttaaaggtagagggctagactttttaaaagaagtaacggaatgtgtcgatattccagtatatgcaataggtggaattaataaagaaaatattgataaagttattgatatgggggcaaaaggtgcttgtataatgtctggatttatggaagggaaaatataaaactgtctttttagacagtttttttattatttataacactttaatttattattttagttatatcaattataataaataataaaattgataaattaatattataatgtaaaaaaataaggtgattaagatgttacttaaacaaatatattattttacaaaaattgttcaaactggaagctttactttagcagcagaagaatgctatatatctcagtctgcaatatctcaacaaattaaagctttagaatcagaactaggagttgaacttttaaaaagaaaaaacagaggtttttctttaacaagtgctggaaaatacttctataaagaaggacttatccttctagaaaaagctgaagaaataaaacaagaaactatagctattgcaaaaaataagagaaactatataaatttcgggtatctaaataattatgaaggtgacagattaaaaaaagcaattattaaatttacatcaatttatcctaacactgatttaaatttaataagcggaaaccatgaagatttatatgaaaatttaagggatggtaaagttgatatagtattaaatgatcaaagaagagcttttagtgataactatgtaaatcaatatttattttcaaacaaatattttattgaagtttctaaaacacatcctttatcaaataatgaatttgtaacaatgcaagatttaaaaccttatacctgtattataatttcatctcaaaagcaggaaaataacgagcagcttttttataaagatattcttaattttaagggagaaactatatttgcaaagaataaagatgaaagcaaactatttatatccgccaatagaggttttaggttatgtgaaaaagaaaataaagaaaataataatttaaaaacaattccactgtttaaagataataaacaaatggaaataaaatattatgctttctggaaaaaagacaataaaaagtatgatttaattgaagattttgcaaaaatgctacttaactaaatcgtaatacgaatcatatgttcacataagttttacttatgatggtgatataaaacttgaattgctcctttaataataaaaatataaaatattattaaaggagatgaagaaaatgaaaaaagatgttgttattttaactggtgccggtcaaataggtatggcaattgcaagaagagtaggctttggaaagaaaataattattgctgacaaaaataaaaaaaatgctgataatatatcaaacataatgaataatgcaggttttgatactgtatcaaaacaaatggatttagctttaagaagttctattattgatattattaattatgcgaaatcatttggtgaaataactatgcttattaatgccgcaggagtatccccttctcaagcatcaatagaaacaattttaaaagtagatttatacggaaccgccgtgttattagaagaagttgggaaagaaataaaacaaggtggatgtggggtaacaatatcctctcaatctggacacagactaccagcattaacaaaagaagaagatgagctacttgcaacaacacctactgaagaattattaaatttagatatatttaaaaatataaaagatacacttcatgcataccaaatggcaaaacgatgtaatgtaaaaagagttatggcagaagctgtaaaatggggagaaagaaatgccagaataaattcaatttcaccaggaataatagtcactcctttagcaattgatgaattcaatggtgaaagaggagaattttataaaaacatgtttaaaaactgccctgcaagacgtcctggaacagcagatgaaattgcaaatatagctaaacttcttttaagcgatgaaggtgcatttattacaggaagtgactttttagttgatggaggagcaaccgcatcatatttttatggacctttaaaacaataaaaaaacagctgattattcagctgttttttctattaaataatttttttcttttaatgctttttcaacaagatccaaaatttcttcactttcactttctacagtatgataatgataattagaagtagtattttttagaggtgtagacttccctttttttattccatcaacaagatttaacacatctcttctagatgaaacatcaagtttcgcagtaagtttaccataaaccttatggtttacaaatacatctataactctagcccctaaatctacaatagtatttaattcatctactatttcatcatcattatgataaaccttaaaaactcttttaaaagtattttttccattaagaatatatcccttatgtgtagaaataatatcgttattttcggctctaagaagtgctatatcttggactataatctgcctgcttacatttaatttttttgcaagagaacttcctgaaacaggttccatattatattttattatatttaatatctcttttcttctgctttttgcatccattatactttaccctacaaagtttttaaatttttcatagataaatcaagaatttttgctgaatgagtaagtgcaccgcttgaaatataatccactccaatatcagttaaattttttatattttcttttgttacatttccagaacactcagtttgagcttttcccttacacatttttacagcttctatcatatcttcttttttcatattatcaagcattataatatcagcccctgcatcaagtgcatcttttaacatttccaaattttcaacttcaacttcgatttttcttacaaaaggagcatattcttttgccatttttacggcttctttaacccctcccgcagcagcgatatgattatcctttaaaagtataccatctgaaagattgtatctgtgattatatccaccccctactttaactgaatatttttcaaatattctcatatttggggttgtctttctagtgtctaaaagctttgtttttgttcctttaagcattgatgcaactttatttgtataagttgcaataccactcattctttgaagataattaagtgctgtcctctcccctgaaagaagaactcttatatctcccgtaattttacctataagttgtttattctttacttcttgtccgtcttttacataaaattcaactttggtatcttcatccaaaagctcaaatgttcttttaaatacatcaagaccggctatgatgccatcttccttacatataagttcaacttcaccttttttatattctttcattacggcatttgttgttatgtcttcacttgtaatgtcttctcttaaagcctgcatgataagattatccatatttaatttcatactaatttgctctttcatgttcttccttgttcctttcaacttctttaagaacttctttcttatatttttcttttagagaagtataatctttatattcatctaaattaatatttatatcaattttatttaatttttcatctttatcagttatttcctttgcagctctttttgcaaatactaaactttcaagtaaagaattacttgccagtctgtttttaccgtgaacgccattacagcttgtttcacctactgcatataaatgttccatagatgtttttgaactgtaatctacctttattccgcccataaaataatgctgagaaggaacaacaggaataggttcttttgtaacgtcatatccttcttcaagacagtgtttatatatattagggaaatgatgctttattactttttcatctataggcttcattgaaagccatacataaggcatattatcttttttcatctgttttaatatttcttttgtaagtaaatctctaggtagaagttcattagcaaatctttccatattcttatttaaaagaattgccccctctcccctaactgattcggaaattaaaaatcttcttcccttcttctttgaataaagagttgttggatgaatttgaatataatctatatttttaagttctattcctctatttattgcgattgctatagcatctgctgtaatatgtggaaaatttgtagaattatcataaagtccgccaattccgccacatgcaaatatagtataatctgcatttataagaaaaacttcattttcttcatttcttgcaacaatgccataacatacattatcttttgaaattatatcaaccatcataacatgttccattattgttatgttatctctcttttctgcttctaaaagcagcttagatgtaatttcttttcccgttgtgtcttcatgaaataatattcttttggaagaatgagccccttctcttgtatatatataattattaccttcttttgcaaaatctacattatatttttccaaatcttttaatatatcaacagaagatcttatcattatatcaacggaccttttatcattttcatagtgcccggctttcattgtatcttcaaaataattgtcataatcatcttcactttttaaaacacacattccgccttgagccaaaaatgaatcactgtttttcgcttcatctttagttattataattatatttttttctttaggtaaattaagtgcggcaaaaagtcctgccgcacctgtacccacaattactatatctgttttcattatctcttccttatttcccaagttcaagcattttttccaaaggtaaatatgcttccttcattaaattttcatctaatactacttcaccactgccattttcaagacagttaagtattttatcaagagtaatttttttcatatcaggacaaatctgttcacatgaaatagtatagaattttttatctttattcttttcttttaactcatataaaacaccggtttctgttactacaataaattcattacatgaagaatttgtggcataatcaataataccggctgtactgcctatgtaatcagcaagttttaatacatcttctgtacattcaggatgaaccaaaacttcagcattttcatgaagctcttttgcctttaataaactttctttatccatttttttatgtataggacaatatccgtcatttaaaataatgtttttatcttttactttttctgatacatatcttcctaaattttcatcagggataaagaaaatatttttatttggcaaactttcaacaatttttaatgcatttgaagatgttacgcatacatcagagtgtgattttaattttgcacttgagtttacataacatacaactgctaaatcatcgtattcctttttcatttgttctattttttctacacttgccatatgtgccattggacaatctgcactttcatcaggcattaaaacctttttatttggattaagtatctttgcactctctcccataaaagatactccgcagaatactattacatcttcttttatttttgttgccacttttgcaagataaaatgaatctccaacataatctgctattttttgtatttcatcatccacataataatgtgccaatataactgcatttttttctttttttaatttctcgattttactaataactgtatctcccattttatactccttaattgacttgtcacatattatagcactaaactttacatatgacaagacagttgtaaataatattaaaaatactttattactattagaaaaaaacaaattttattatataattatggtagactttttatattaaaatatgttaccataggctaacataatacaatttaaggagagttatatgctattacattctttggaacatgcttttaccgacagcattaaaatatttccgtttttacttattacatatataatacttgaatttattgaacataaaacagaagataaatttaataagataattgaaaaagcaggtatattcggcccaattttaggagctttgcttggagcaataccacaatgtggattttcaactgccgcatcaaatttttacgcaggaagaataatttcccttggtaccttaattgcaatctttttatcaacatcagatgaaatgcttcctataatgattgcaagtgctgctcctatttctttaatacttaagataattttttcaaaagtgataatcggaatattttttgggttaataatagatatactacttagaaaatcagacatagaccataaagtcaatatgggacacagtgataaccatatgcatgatgattgcaaagaagaagaaagttttttgttttctgcaattaaacacactataaatatttttattttcatatttatatttacatttgtactaaatatttttattgaatttattggagaagaaaatctttcaaacattattttaaataaacctgtaataggttcattaatagcaggaattgtaggacttatacctaactgtgcaggttcagtaataataacaaatttatatttaagtggaggactcggctttggagccatgatggcaggattactggtaagtgcaggagttggtcttttggttttatttaaggttaacaaggacagaaaagaaaatattaaaattcttatccttctctatctaataggttcaatttgcgggataataattgatttattttcaaactttatataaaaaaggtatatcaaattgatatacctttttatttttatagtgtaaatataaatttctgtgttattgcaacttcagtaaaaaacaaaagaaagagctaaaagaatatatattaatcgctgtagaattcttcttgtgtttctatgcaatatgccgccaactttcctccatatacacaaccgcaatctatggcaatatgcccattttgtttgtatatatgaggttttctgtcatcattaattaacatagtcggagtatgtccgcttataaaaaaagtattttcatcttcaagatatctttttgaatagtcacttcttccttctatataatcaaatatttcatattcaccgatttctttatctttatcaaaattttcaagtccggcatgagtaagaatataatgtttattgttatgatatatttcttcatataaacttgcattttctatataatgagccaatgctatcttttcttctttactcatctttttaaattcattcattgttattttcccgccgctttcgctccatgcaaaatataaatcaatatccgcagaagataagcttttcttatctttatcttttaaatcattgtcaaatttttttatcatttcataaaaaagaaaatcatgatttcctagaagataaacaacatttttcctattcattatatctttaaatacatccattggtttgggtcctctgtccaccacatcacctaaaatatataatgtatctttctctttcaagtttattttattaattaaatccatgtactcatcataacaaccatgtatatcacttattatatatctcataaaaaccctctgattttattttatatagtaattttatcataaaatataaatttataatgttttataatattaattttttttaataaaaaaacacccttaataaagggtgttttaatttcgcttcacttaaattacatcattggaggtgtcatttgaggagcgttgtcttctgatttaatatcagcaacactagcttctgttgtaaggaacatagcacttacacttgcagcattttgcatagctgatcttgttactttagttgggtctacgatacctgcttcaaccatgtctttatattcaaagttaaatgcatcgaaacctttacctttttcttcatttaataatttatcaactactacactaccttcaacacctgcgttaaatgcgatttgtctaagtggagcttcaacagcttttctgataattgcagcacctgttttttcatctccttctagagagtttacaagttcgtctaatgctggaattgtagaaatcattgcgctaccaccaccaggaacgataccttcttctacagctgctcttgtagcattaagagcatcttcgattctgtatttcttttctttcatttctgtttctgttgcagcacctacttgaattactgctacaccgccagaaagtttagcaagtctttcttgtaatttttctttgtcatattctgaagttgtttcaggaatttgagctttaatttgatttcttctgtcttcgattttttctgggtccccatgaccttcaacgatgattgtgttttctttatcaactctgatttgtgttgctctaccaagcatatcaagagttgtagatttaagatccatacctaaatcatcacttattactgtaccacctgttaaaattgctaaatcatcaagcatagcttttcttctatcaccaaatccaggagcttttactgctacacagttaattacgcctctaagtttatttacaattaatgtagaaagagcttcgccttcgatatcatcagcaatgataagtaagttacctgcagcttgttgtaattctgttaataaaggtaagatttcttgcatattgctgatttttttatctgttaataagatgtatggtttgtcatatacacattccattttttctacatctgttgccatgtatgctgataaataacctctgtcaaattgcataccttctgtgaattcaagttcaactttcattgactttccttcttcgattgtaataacaccgtcattaccaactttttccatagcttctgaaataagttcacctactgtttcatcagctgaagaaatagctgctacttgagcaatagcttttttaccttcaacaggtttagaaattttcttaagttcttcaacgaatttatctactgctttttcgataccttttttaagtaccattgggtttgctcctgctgcaacgtttttaagaccttctccgataattgcttgagcaagtacagttgctgttgttgttccgtcccctgctgcatcgtttgtgtttgttgcaacttcttttacaagttgtgcacccatattttcaaagttatcttcaagttcgatttctcttgcaattgttacaccatcatttgtaatgattggagaaccaaagcttttaccaagaacaacatttcttcctcttggtcctaatgttactttaactgtatcagctaatttatcaactccggcttttaaaccttctcttgcttcaattccgtatttaatttcttttgccattttatatcacctttccttatctactaattattaaaattatttaacaatagctaaaatatcgttttgtcttaaaataagatattcttcgccttctaattttacttctgagcctgcatattttgaataaataacagtatctccttcttttacgtctaaagcaacttttttaccatctacgatttcacctgtaccaacagcgattacttcacccataacaggtttttcttttgctgtatcaggtaaaatgatacctgttgctgttttattttcttcttcttttacttttattacgactttgtcgccaagtggttgtaatttcatgattaactcacgcctcctaaaatatattttatattagttataatcaatctcgttagcactcctcttctctgagtgctaatagtattttagcacacttatatatattgtcaatagtatttataaaaaaaattaattatcttttaaaatttttctctaatttaatgttaaagataattataaaaaaagaaccgagaaattaaaattctctcggctctgaatttaaaatatattctctttttactcttttgtttatacaacataaaagctcataaggaattgtttcacataatatagctaaatctgaaacacttatattttctccaaatatttcaacgctatctcctatgtttatgtctgcatccataggaatttcaagcattgtcatatccatacatacgtttcctattacactacattcatatttaccattaacaagaacctttcctttgtttgaaagctttctgttatatccgtctgcataccctacacacattacggcaactcttgtttttttatcagctgtaaaagttcttccataacctatggtttctcctttttccactgtaaaaatattgcttatgcttgtgtgaaaagacataacaggtttataaggattaatctcgggtttaatctctgaaggataaattccataaagaacaataccagctcttacaccatcaagataatattcatctaaatcagttatcgcggcagaatttgctatgtgttttatttttatgtcaaagccatattctttagctttatttattgcatattcaaatatttcatattgcattttgctataagttttatcaacttcgtcacttgttgcaaaatgagaaaaaattccttcaaattcaagatttgtaagctcctttaaagcggcaaaagcactgtcaatttcatgctttttaaatccaagtctgttcatgcctgtattaattttaatatgtacccttgcttttgtattgttttttaaagcttcttcatttaatttctttgcaaaatcaagattgtatattgcaggaataatattattttctaaaattttattaatctttctatccggaacataaccaagtattaatatatcactgtcaataccatactctcttagacacatagcttcatacacactggaaacagcaaataaatcagctccttcttccattagaacttttgcacatatttctgcaccgtgtccgtatgcatcagctttaattacaggtattacttttttatctccaactttattttttattactctgtaattattaattaaattatctaaatttatctttacacccgtttgaaatctttccattttcaaattactccataatattcattttttgataaaattttacaaaatataatgaatttgttatcttttctacaaatttatacacatatcaacagacttatccacagttttccacaattattcacatttaaaagtacttattttaagggattttgtctattttatacacatgaattatcaacaattttattatattttacattgatgatgtttaaaaatccacaaaaaatgttgataatttttattacatttttattaactttttaactatatattacaattttaagtcaggatttgcatttaaaatcagactgtcttttttgttatttatataattaaaatatccactacatccaatcattgcagcattgtccgtacaataaactttatcaggaataaataattctatgccttcttcttcgcatcgtttttttagttcatttctcagcatatcgttacaaagaactccaccaccgacacaaagtgtcttcatattttcttttttcagtgctaacattgttttatttactattgtatctacaacacatctgttaaagcttgcacaaacattgtctatgttaatctcttcatttttcattttcttactatttaaatagttaagtaccgcactttttagtccactaaaactaaaatcaagattatccttacccatcataacaataggaaaatcaatgctgtgttcatctccttgttttgcatgcttatctatttgaactcctcccggataagaaagtccaaggcttcttgcaaccttatcaaaagcttcccccgcagcatcatctttagtagaaccaagaagttcgaaatcagtatagctattaacctttgttatatttgtgtgtcctccgcttgccgttaaacatacaaaaggaggttttgcacccataagaaaacttgcgcttatatgccctgccatatggtttacaccaactaagtctttatttaaactaaaagcaagagcttttgcataagataaacctataagtaaagctccaacaagccctggtcctgtggtaacgcttataaaatcaatatcatcaaaagttacacctgcatctgatagtgctttatctacaacacttgaaatcttcattaaatgatttctagatgcaatttccggaacaacccctccgtaaactttatgaatatcaatttgtgtatgaattacgtttgacctaacttttataccgtcttcaacaactgcaacacttgtttcgtcacaggaagtttcaatcgctaaagttaaaatactactcatcttctttatcctcttttttatttatatcttcagtttcttcttgtttttcattatcatcattttcttttagagtttcttctctttttctcattgcttcttcaaattttctgcttttcatttgttcaaatttttgtttagttctgattatatcttctctgctgtcattaatactcattagtgttatatattctgtcttttcccttttcatttggaaacgcaaatatagtgaaacaagcattacaatgcttcctattcctattaaattaaatacaaatataataagtgaacttaatatacctatagacaaaaattccaatgcaagcagaataaacacaccagtaagcattttactagataatttttgaccttttacaaaaagtccgccaataacaagagccgttggaatagttgcaatataagttaagttaaaatataaacttaacaaatgaagcgcaaccggaatgccgacaactgtcattattaatataaacataagaggagttattacaagcattgtaagagcccccatgcttaaacattttaaaatatttcttcttgcaaatatctctacttttaaagcacttatagggaataattttataagaattaagcctatgattaaaattgttatcttgcttaaattattataatatccaagaaaatctgcaaacacactgctatcagaagtcgtaatgctttgaggaatattaagacctaaatcttttttttctactcctccttttatcttgctttcttttgtcttaactataggattttcactttcatatataagtttaccttctatctcagcttcttttcctattacaagttcattacatccaaccttaacatcaccatttattttactgttaattgttacgctatccccaacaataaaaacatttccgttaacagttccttttaaaagaacatcatccacaaatacatttacatcttcttttataaatgttttttcgtttgtaattaatttatctccatatacaattaaatcaccgtttattgtagcattatttagatataaattattataaaagcctattaaatctttattgattgtacctgtagaattaaattcaggtgaaaatgatataacacttccatcaatgtatcccttattttccatattgcttgtaagtgctattacattaccgtttatctttccttcatttactatatttgtataaactcccataaaaatggatttatcatatgtatcttttttatttaatgaaaaaaaggttcttgttgtatttgtttttttttcttctgtcccatcagtttttgatgcagcaagaataaatgaaggcaccatacaaagtaccaatataattaatataaaaatatttatcttattcttaaatttttttgtcattatatctccccaaaattattcttcaaatcgccacattatataagcatcttcatgattatccgcataataattttttctttttccgtaaattttaaatccagcactttcatataaatttattgcaggctcattagattccctaacttccaaagtcatttcattaatgcctttttttaatgcgtgctttataaggataagcaaaagatcctttccatacccttttcctcttctgttttcctttatacccattgtcgtaatatgcccttgcccgacaatatcctgataacctccaaaagctataagctcatctttatcataaaaaactatataataacttttatcgtttataagctctgaaaaaatagaattatcagaccatggatttgcaaaacaacctttttcaaactcaattatatcttctatatcggtaattaccgcttctcttaccaaaatactcatattatactcttttattcttttccaatctttgttcttcagctgcagaaggtcttatataattcggcaagaaattgtcataacggtaaatttttttattttcctttaaatgttcttttgctactatacaaacaccgcttgcctttggaagataattataagtagtggcaaatatagctttatctttaagtttttccttaattttatctttatattttattatcccgtctccagcaaataaaaccctatcaaagtcttctgcctttgaaataacctcttcaatattttttattccatcttcatacttagctgataatttagaatctttttcaataaacatattaaaataagtatcatttctttgtgcatcaaaaataacaaaaataacatcatttagtccttttacattgtttgcacaagcttccaaagaagaaacagaaataataggcttattttttgtttgagaaaatgccttaactgtagctgccgctattctaagtcccgtaaaagacccaggaccattgcctacagcaaaataatcaatatcatcaatagtaagtcttacgtcttcaagaagatgttttatcataggaagaagtttttcagaatgtttaagtttatacgcagtatattcttctccaagtattctatcatcttccaaaattgcaacgcttgccgcaaccgttgaagtatctattgcaagtattctacacatacatttcctccaatttatctataatatctttagactcttcatctaaagcttttatatttatatttctttcattaaaatcatttgttgatttttctatatttacaataataccgctataatcaagttcatccattatcatgtctgcccactcaattatcattttatgttttttataaatatcataaaatcctatataatcaagttcgcttatatcttcaattctataagcatccatatgataaagaatattaacgccatctttatattcgtttattatggtatatgttggagaagaaaattctgatattaatccaagacttttagcaatacctttgctaagctgagttttaccgcttgccatttctccaatcaaataaacagtcgtattatcctttaaaagtttccctatattttctccaagtttcgtagtttcaatatcattttttgttactaaattcataaacttttcctattctattttaaacttaaagtatattatatcaaaaaataatatattaataaatatataacgcatatttcataaataaaaaagaagcggttaaccgcttctttaaattgatattttattcaaattctattaataattgaccggcttttacattgtcaagttcttgaaccaatacgtcttttattacaccgtcacatggagcaacaacttcagtttccatcttcattgcttcaacaacacatacagattggtttttcttaacttcttctccgattgcaacatttactttaattacagaaccaggaattggagaacctatatgtttttcatttttaggatcagccatttcaattattttatcagttgtttgattaaccacaaagtttggatcatttacatataaaactcttctgaagccgtcaacttcataaaccattcttcttgttccgtcaggatgagtattaccgattcttacaagtttaattacatgactcttaccttcaccaaagaatatttctgtttcttcgcctagtgctagccctgtaaagaaagcatctgaaggcatataagttaaatcaccataatcttctttgaattttagataatctttataaacttttttataaagtgctgcagaaagaacttgtttttcatttaattccataccgaattcttctctaaattcttctcttatcttatcgaagtcttcatctggaagaagttcacctggacgttttgtaatatattctgcacctttaagaacaacttctcttaatttttcatcaaagccccattcaggttgaccaatcattcctttaaagaaatctacaacactgtctgggaatgctaagtcttttcctttttcatagatattttctttatctaaatcattttgtagcataaaaattgcaaagtcacctacaacttttgatgttggagttactttgattatatcaccaagaagttcatttgcttgtttatatttttcaagaacatctgtaaatctatgtccaagtccgaaactttcaacttgagatttaaggttactgtattgtcctccgggaacttcatatttataaatttgagttgttcctgtttttaagcctgattcaaatcctgtatagtattttcttgctttttcatagtagtcacttacgatttgaatttcatctaaattaatattactttgtcttggagtatattcaagacctgcaactattgcttcaagagaaggttgtgatgtagttccactcattgaagaaagagcaccttctacaatatctactcctgcggcacttgccattaacatacttgaaacaccgtttcctgctgtatcatgagtatggaaatgaattggaatatttacttcatcttttaatgcttttgcaagtttcattgctgcagcaggttttaataagcctgacatatccttaattgcaagaatatgcgcacccattgcttcaacttcttttgcttttttaatgtagtaatccaatgtatatttagttttgtttttatctaatatatctccagaataacaaattgcaacttctgcaacttttccaagttttaatacttcttcaacagaaggtttaatttgatctaaccagttaagagcatcaaacactctaaatacatcaacaccgctttttgcactttgtttgataaattctttaattacattatcaggatagtttttatatcctacggcgtttgaacctctaagaagcatttggaataagatatttggaatcatttctcttaataattccagtcttgcccatggagattcttttaagaaacgataagatgtatcaaatgttgctccaccccatacttcaagagcataaacatctttttcatagcggcttacgctttctgctattttcaagaaatcaacggttctcattcttgttgcaaataaagattgttgcgcatcacgcatagttgtatccatgaataaaagctgtttttgatcttttatccattttacaagtccgtcaggaccttgttcatcaagaatttgttttgttcctctaagagcaggcatgtctttaaatctaggaacttctatttttggtataatttctttattttgattatcatgttttaatgttgtttcagataaatatgtaagaacttttgcaagttgatcatcaaatttttcaatattgaaaagttcaggatgatcttcaataaagtttgtattacatattcctttcttaaagtcaggatgttttaaaacattgataaggaagtctttgtttgtagaaacaccttcgatttcgtgttcctttaaagttcttatcattttctttcttgctttgtcaaagtctcttgcatatgttgttgttttaacaagaagactgtcaaagtaaggtgttatttcagaaccggcaaaaccattaccaccgtcaagtcttacccctggacctgcacctgttttgtatattgtaattttacctgtatctggcataaagttatttaatacattttctgttgtaaccctacattcaattgccgcaccactcatttttatatcatcttgagattgaatgtttatttcttcatctgtaagtttatatccttcggcaattaaaatttgagcttgaaccaagtctacatttgttacaagttctgtaacagtatgttcaacttggattcttgggttaacttccataaaataatgtttttcattttcatcaaccaagaattcaactgtacctgcatttgtatatccaacgtgttttgcaaggtttactgattcttcacaaattgctcttcttgtttcttcactaattgattgtgaaggtgaaaattcaataattttttgatgtcttctttgaatagaacagtctctttcaaaaagatgaacaatatgcccgtattcatcggctaagatttgagcttcaacgtgtcttggagaacgaacatatttttcaataaaaacttctccattgttaaaagctttttttgcttctcttacggcagattcaaattgaccttttaaatcttcttccctttcacaaactctcatacctcttccaccgccgccggcactggcttttattataacagggtatccgatttttgcactaatgtcttttgcttcttcaaccgtatctacttttataccatcaagaacactaactccggcttctatcgctgcatttttggcattaactttatttccaagaagttcgataacttttgaatttggtccgataaatttaataccggccttttcacattctgccgcaaattcaggattttctgataaaaatccatatcctggatgtattgcatcaatatttttagcctttgcaagttcaattattgcttctatgtttaaataggcgtccgttggtgaattggtacctttaattagataagcctcatctgctttacttctaaaaagtgataatttgtcttcttcgcagtaaatacaaatagctttcattccaagttcttgtaccgctcttattattctaattgcaatttcaccacggtttgcgattaaaactcttttaaaatttttcatcatgccctcctctttccatatattctaaatattatactaaattttcttaatttttaaaagactttttataccattattataaaaaaatatatatttattaattttttgtaatatttatgcataaattatctaaattatataaaaaaagcagcttaaagctgctcttttattttctaatttgtccattaccggtaataatatacttaattgttgtaagttcatttaatcccataggacctcttggaagagttctttgtgttgctattccaatctcacttccaaagccaaactcttctccgtcggtaaatcttgtagatacatttacataaacacaagcactgtctatttttgatgtgaacatattcattcttgaaatatcatttgtaactatacattctgaatgttttgtagaatatttatttatatgatttattgcttcttcaatactttcaacaacctttacagcaataatataatcattgtattctgttttataatcatcttcagttgcttttttaacagccttgcttccaaggatttttattgtcttttcgtctcccctgaattcaacattatgctcttttaatctattatatattaaaggaagaacttcttttgctttcttttcatgaacaagtaatgtttcaagagcattacatacacttggacgttgagttttcccgttatctgttaaattcacagccatttcattatcggcaaattcatctatatatatatggcagtttcccgctcctgtttcaataaaaggaactgttgcaatgtcttttatcgattttataagtcctgcacttcctcttggaattaaaacatctatataatctgttaatttcgccatttgagaaacatattttctgtcagtatctgtaacaagctgtataatgtcatgattaagccctgcttttcttattgctcctctcataatttccacaagctttgtatttgtgtttatagcttctttgccacctcttaaaatacaagcattacccgattttaagcataaacatccggcatcaaccgtaacattaggacgagactcaaaaataattccaactactccataaggaactctttttattacgatttccattccattaggcctttttgagcctccggaaacaatcccaacagggtcgcttaaatttataactttatcaatagagcctgcaattgcttttattctgtcttcgttaagcataagtctatccaccatagactcctttattccgttgattttcgcagcagaaatatcttctgtattagcttttattatttctttcatatgaagaataagttcttctttaatgcttcttaaagcctcgttctttttatcagtattcaaatccataagacttctgcttgcaatttttgctttctttcccaaacttgccatattaaacattaaaatcacctcaccttaaataatgttcctttgttttcaccgtcgaataaattatataaatcatttggattttttgatgaaagaataaccatatcaaaattattttcaaaagcaatttgccctgcttttatttttgtaatcattccgcccgtaccaagattattcacagcgccaccacaacaatctataatctcatcggtaatttcttcgacaacttcaattcgttttgcatttttatttttctttggattatcagtataaagtccatcaatatccgtaagaataacaagaaggtctgctcctattattgaacttacaacggcagataaagtatcattatcaccaaactccaactcttccgtactaacagtgtcattttcatttactattggaattacattatattttaaaagctgttcaaaagtattatatatatttgaaatatcagcattttcaccaacaacgtcatttgtcaaaagaacctgcgctacattgtggttatattcaccaaacaacttatcatacagatacattaattcacattgtccgattgccgcaagagcctgtctttttgatattgttttgggctttttatcaagaccaagtttccccattccaaccccaacagcacctgaagaaaccaatacaatttcttttcctgaatttttaaggtcagaaataatctttaccaaatgttccactcttcttatgtttatattccccgttttgtgagtcaaagtggatgttccgattttaattacgattttttttgcttttactacgttttccatattatgtccttatttttattttatattaattttattattgataaactagaaaatacctttattgtatttaaactgtccgtaaagcatgataactagcccaattattatccctaatacaactaagtgctcaattatgtcagttttaaaaacaagttcaaaaatagcacaaacgacaaaagagaaccctattattaaacttccaacccccatacatttaccatatttaggaatatcagcttttacaacttttcttctgttataactatgaatagtggaaatatttccccttatatttaatataccgcatactaaaagaataataccaataagaataaatgtaataaatttttccattgcttttccctttactaaaaatcaaaaattaatatgttatttattataaactttaaaacaaatacggtttaaatatagtcatacagatttttatttattatataaaaattccctaataaagtaaagcaagaaaaaataaaataaaaacttggcaaagccaagtttttaatatgttatgtaattttttattacgtttccttcatgatgattcattaaagcttcttttacatcttcaagcttatattcattatatacaaaatctttttcatctattactttcattttcaaaagttcaaatgcttgatttacgtataaaggagtagtatggtaaagaccttttattgtaacttgtgaataatgaagaagttttgtgtcaacagttagaacctctcctgcttttgttccgccgtataataaaacaaaacctccgggacgaaccatattaattgacatttcccaaacttttacgcttcctgccgcttcaattgctgcatcaacacctcttccttcaggtgtaagatcttttactgctttaacttgatcttcaacttcatctatattaatcacatcataagcaccaagtttttttgctgtttcaagtctaactttacttctgtcacaagctataactctcgcaccttttaaatatagaagtcttataaacataagacctgaaggtccacatccgttaactgcaacataatctccttgttcaacaggaacttgagaaactccatatacgctacatgcaaaaggttctaataaagctgcttgtttaaaactcatatcatctggaatatggaacatattttgtttaacaattctttcaggaataagttgatattcactaaaagcaccatttttcaactgatttgcaaggaaatcttcacacatacaatgaataccttttttgcaataataacattcattacatggtgcagaattgtgagcaacaactctatctccaactttaaacttagtaaccccttcacctacactatcaacaataccgcttgcttcatgtccaatattataaggaggtgtatgttttgcatatcctcttaaataactttttacatcagaaccacaagtaagagaaacttcgtttttaattaaaacttcgccctttccaggttttggcttttcacattcgataattcttaaatcccccggttcatgcaacattacttttctcaatttaacgtacctctctttaaattaatatgctattcatagtttatcattaaacggtatcattcatcaagaaataaatttattaaattttacaaaactactgttaaaatgtttaggctaaatgttaaaatacatttaggtggatattatgaatttaaggatagatacaaaagcggaatacattttaaataaattaaaagaaaacggatttgaaggttttattgtcggtggatgtgtcagagatttaattttaggaaaaacaccaaaggactatgacataacaacaaacgcaaagccagagaaaataatagaaacattcaaagaccataaaacaatattaacgggaataaaatacggaaccgttactgttttaatagataagataccttttgaaataaccacatatagaaaagaacaagaatatataaacaacagaaaaccaaaaagtgttatatttttatcttcaatagaagaagacttatacagaagagattttacaataaattccatggcttataataatgataaaaaactaatagatttatacggtggcgtaaatgatatacaaaaaggtattataagagcaattggaaacaaggataaaaaatttgaagaagatgcaattagaattttaagagcatatagattcgcaggaagatatgattggaaaatagaagaagaaacaaaaaatgcaatgttaaaaaacatgaatttacttaataacattgcaaaagaaagaatcatacctgagcttaaagaaatatttgaaagcggtatggatattaacaaaatggaatttattacaactttattccctgtaataaaagattgttttaatacctatcaaaataataaatatcatatgagtagtgttggagaacatatttacaatacatttaacaatatagataatgtatttcatttaaaaatgaccatgcttctacatgatataggaaaagttgacacgaaaacgacagatcaaaacaatgttgaccatttctacaatcatgcagatatttcccgggaaaagtcaaaaataattctaaatgaatttaaattcgacaataacacaaaacataaaatacttacattaatagaaaatcatgataagtatatggcacctgatcctaaatatataaaaaaaatgttaaacaaaataggcgaagatttgttttttgatttaattaaagtaagaattgcagacgacagtgcaaagaatcaagaattggttaaaaacaatataaagattttcaatgaaactttaactcttacaaaaaaaatcataaaagaaaaacaaccttatagtattaaagaccttgatatttcaggcaaagaccttatagaacttggatatgaaggcaaagaaattggagaaaaattaaattatttattaagtaaaataattgaagctccatctttaaataaaaaagaaacgttaaaaaagttaataataaaaaaataaaagcctgttattcaggctttttattttcaagtaatggcggtttgttttcatcttttctatcactaagccactgagaaatcaaaatcttaagaactgcaaatataggaatacctataaccatacccacaacgccaaacagacttccacagaaaataatggatacaataacccagaaaccgttaagtccaaccacatcaccaagaatattcggagcaagaacattttgatctatttgttgtataaatataatgattaataccattataatcccctgaacaggtccaccggaaatcatggcaaaaatagaacaaggtattacgctgaaaataggaccaaacaacggaatcatatttgttatggttattataaaagcaattaatgttgcatatttaattttaaataatgttgcaagagcaagacctaatgccccaactattaaagaacaaatagctttaccggataaaaatttaaaaaacatataatccataagtcccagaacataagaagctcttccatacattctttcagacaaaatagcttgagtaaatctttttaattgacttaatagaatttctttgtctataagcatatataaagctataaaaattgctataaaaacattatatattgttttaccaaggctcattgtggcattaaataaatttgcaccaagtccttcaacccaagttttaaagaaacttaaagtatcgagtattgtagcattcattccatttgaggtagatatgtctatattgaatatattacaaatactaacaaacacaggatgatttgctaaccttgtgataaaaccttcaatctgccccatgttttcctgaacagaagctataagagaacttatacttgtaatggtactcggtaaaactatataaacaattaaagtaattatcaaaagagctataatcattacaataagagaagataaaactctttttgctccatctttttttatgtttgtccttttttctaagatatcatgtaatttatcaaccggctgatataagaaaaaggcaataataaaacctattaaaacgggctttaacggaatataaaatatattccatatatcttttaattcttcaagaaaagaagatatgttttgaattccaaaataaaaagctataatgaaacaagctgaaagagtaaacagaattgcatattctttatattttttgtctatgtttctaaattttttcattaaaccactctcttttaaatatttatggataatattataccatacatattaattaaaatatttaaaaatcctatttttaaatataatttatgatataattaaaaaaattttaataattttaaaagaggttgaaatgatttattatttaattgtaattttatgtataattatagaccaaataagtaaatatattgttataaataatttaaagccgattggaagcatacctataatagaaaatgttttccatcttacttactgtgaaaataccggagccgcttttagtatgttttcaaaaaacacagcagtgttaacagtagtaagtttagtatttatttttctagtatttttctttttattaaaaagcatcaaaaagggaaaaacatcaaaaatcatgtctttcggtcttgcttttatattaggaggagcaattggaaatttcatagatagattcttccatggttttgttacagacttctttgattttagacttataaattttgctatttttaatgtagcagatatatttattacaatcggggcaatactattttgtatatatgttatttttacaaaagacgaaaaaatattttaaaaagaatagacaaaagtttattctttttattttaataataaaagaacaaatgttcattttgttatatactttataaacactatatgataaaatatgttaataaaatatttttaaaaaggagaaaaaatgccaaaatttaaagtacattcaccttttgaaccttcaggaggacagcctgaagtaatagaaaaattatctaacagcatattaaacaacgaaagagatcaaacacttcttggtgttacaggctgcgggaaaacttatattatggcaaaaataatagaaaaagttcaacgtcctgctctcataatggcacataacaaaacattagcagctcaacttgcaaatgagtttagaagtttctttcctgaaaatgcggtagaatattttgtaagctactacgattattatcaaccggaagcatatgttcccggtagagatttatatatagcaaaagactcaagcataaacgatgatatagataaacttcgtcactcagcaacatctgcattatttgaaagagatgacgtaataatcattgcatctgtaagctgtatatacggacttggtagcccaattgactataaggaaatggttttatcattaagacccggaatgataaaagaacgagatgatgtaataagaaagttaattgatatacaatatacaagaaatgatattgattttcacagaggaactttcagagtaagaggagatagcgttgaaatattccctgcaaacagcagtgaagaagcaataagagtggaattttttgatgatgaaatagacagaatcgttgaaataaactctattaccggagaaattttaagaagtttaaaacatgcttttatttatcctgcaagccactatgttacaaacgaagaaaacataaacagggcaataaaatcaataagcgaagagttaaaaattagagcaaaagaatttgaagataatgggaaattattggaagcacaaagaataagggaaagaaccaattatgatattgaaatgttaagagaaattggttcttgcaaaggaatagaaaactattcaagacatataaacaatcttcctgcgggagcacctccttatactcttttagactacttccctaaaaattatgtaactttcatagacgaatcccatgttaccgtccctcaaataagaggaatgtatgcaggagacagagcaagaaaaatgaatcttgttgattatggattcagacttccttcagctttagataacagacctctaaactttgaagaatttgaagaaagaatgaatcaattagtctatgtatctgcaacccctaatgattatgaaaaagacttatcaacaacaatagcagaatgtattgttcgtccaacaggtcttattgaccctaaaattaccgttaaggaaacaaaagggcaaattgaagatttaataggaagaataaaagaaaaaactgctaaaaaagaaaaagttcttgtaacaactcttacaaaaagaatggcagaagatttaacaacatatttaagtgaagtgggaataagagttgagtatcttcactctgatgtagacacaatagaaagaatgaagcttattaaagacttaagagatgatgtttttgatgttttggtaggtataaaccttttaagagaaggacttgatataccggaagtatccttagttgctattttagatgccgataaagaaggatttttaagaagtgaaacatcacttattcaaacaataggaagagccgcaagacatttagacggcgaagttgtaatgtatgcagacacaataacagcttccatggataaagccataaaagaaactcaaagaagaagaaaaatacaaacaaaatataacaaagaccataacattacgcctaaaggaatagtaaaatctacggataatgctatgtctgcactgtcaatggaagatatcgaagataaaaaatcagctaaaatccaaaagagaaataaaaaagactttaacaaagatattgatgaagaaattgaacttcttacaaaacaaatgaaattatatgctaaaaatcttgaatttgaacttgctgcaaaagtcagagatgaaattgaacaattaaaaaaattaaaaacaaaataaactccataagggagtttttttgttctatttttttataaagccaatatatattaataaataatatttttaggagaaaaactatggacaacaaaaatataacagatcaaagacttgaattatacaacagaggcaatttaaaaataaatgattgtcttgatgttcataactttaatgacgaaacggtggttcttgaaacatctcttggaattcttaccataaacggagaagaattaaaaattgaaaaactaaatttagaagaaggagaaattgcattaaacggaaatatatatgctctaaattatgatgatgacataacatttatggaaaaatcctcaggattattttccaagatattcaaataatgactgatactatttattctcaataccttatcctttttgaaaccttttacggaggttttattttaggaatcatgtatcacacaataactataatagtttatgccataacaaaaaaaataaatttatcggatttatgtttttgccttgtaggagcagtatttaccattgacttattctttaaaaccacatattttgaattacgatattatagtattgtaagttttattatgggatttgtagcttattactttataatatcccctatttataaaaaacttttattttttattacttcaaaaataggacgtacaaacaaaaaaataaaaagaaaaataaacatgaaaaaaaatagaataaaaaataaatacaaaggtccaataataaaaattaaaactttattaaaacatattttatctattccattaaaaataaaaataagttataatacattcagaatatataaaaaagaaggaataggtattaatgagaagagaaaattattctttacaaaataccaacaacagcatagacgcaaaaagaagaatagtaaaaagaaaaaaaagacgtgcgggtaagaaaaaaagagttataactttaattctaattgttacctttgttctttttgcgggcagaatgcttacgcttgagtataaatattatactttaaacaaaacaaaagaagaactttctcaacaaatagaagaagaaaatttaaagtcaaaagaattaagtgaagaacttgagaattcaaacagcaaatcatatatagaataccttgcaaaaaaatatttgggacttatatatcccgatgaaaaagtatacgtaacaaacgaaggggacaataaaagtgagtagttttttatttgacacacatgcacatcttaacgatgaagcttttgataaagacttaacagatgtaataaaaaaattacaaaatgaaaatatggatggggttgtgaatgtcggttatgatcttgaatcgtcagtaaaagccattgagcttagtaaacaatacgattttttctatgcatcggtagggcttcaccctcatgacagcaaagactataacgaaattcttgaaaatgaatttattaagcttataaaagaaaatgaaaaagtagttgcttatggagaaataggacttgattattattatgacaattctccaagagatattcaaaaagaagtatttataaaacaaatcaaagctgcaaataaattaaataaacctatcatagtacattcgagagacgccgtaaaagatacatatgatattttaaaagaatatttaggtaataatacaggaatcattcattcttgttcggcttctgcggaaatggtaaaagaatatttaaaacttgggctttatatatctttttccggaagcgttacatttaaaaatgctgaaaatgtaagaaatgcggcaagagctgtgcctttaaacagacttcttattgaaacagactgtccttatcttactccggtacctcataggggaaaaagaaacgacccttcctatgtaaaacacactgcaaaacaacttgcagagattaatgacgtaagttatgaagaattagttgaaattacaaataataatgcaaaagaattatttagaataaaataaaaaaggaatgttttacattcctttttttaatacgatatcacatatttccataggagaagaaactatatagtcaggtttatatttttcaagttcagcccttgaaccatatccgtaagtaagaccaatggtacttagtccattttctttacctccctcaatatcattgtatctgtctcctaccatacataccctgcttatatcatttactttcatttccatcattgccattttgataaattcaccttttgttcctctattttcatcccagttatttccaacaacaacatcaaaatattttataagatcaaaatattttaactgagaaacagaagcctcttcaggtttatttgtagctatagcaagttttacattataatcctttaaagtttttaacatttcaggaattccttcatatacactgcattcataaatacctttttccataagtctttttctatgaagtttcatagcttcaattccatcttctttacttaaaccgtaaacttttactatcgtctcagataaaagaggacctaaatgattttttatattgccaatgctttcttctatgccataagccttaagtgctgattgaaatgacctgcaaagaccttcatgtgaatccaaaatagttccatccaaatcaaatatcagatatttaaatttcatattatcatatattttattaatttaatacaatatcagcaatatcagaaggtttttttgcaatatgagtaggtttgcaattaacaatttcttcttcagagccatatccgtaagttacaccaattgtatcaagtccattttcaacaccaccttcaaggtcgttgtatctgtcccctaccatgcaaacttcacttttatcctctacacccatatggtccatagccattcttataaaatcgccttttgaacctctggtttgagtccagttattaccaacaataatatcaaaatattttgcaagttttaaatgttctaattgtaaaacagatgcttcttcaggtttattagtagcaattgccatttttacgccattatcatacaaagtctttaacatttcaggaatttcatcatatattttacattcataaatacctttttccttaagtctcttcatatgtattttcattgcagctgcaccgtcttcttcactaaaaccatactttgttatgattgttcttgaaagtggaggacctaaaagttttttaatattatcaacgctttcttcaactccgtatgctttaagtgctttttggaaacacttacaaataccttcatgtgaatctaaaattgttccgtctaaatcgaatactacatatttatatctcattttattacctcatttaatgtttattagtttaatacaatatctgctatttcaagaggtgtgtttgcaatgtaagtaggtttacaattttctatttcctcttttgaaccatatccataagttacaccaattgtgtcaagtccattttcaacgccgccttcaaggtcattgtatctgtctcctaccataacagcttcttttttatccttaacgccaatagcgtccatagccatttttataaattctgcttttgttcctcttgtttgttcttcattattaccaactataaaatcaaaataatcttttagttttaaatgttcaagttgttttattgaaatttcttcaggtttatttgtagcaatggctattttaatgccgttttcttttagcttatcaagcatttcaaacattccatcataatactgagcatcgtaaataccttttgttttaagataattcatatgaagtttcattgctgcttttccgtcttcttcgctaaaaccgtattttgttataattgttttagataaaggaggacctaaaagtttctttatattttccaaactttcttctactccgtatgctttaagtgcaccttggaaccccttacaactgccaagttgtgaatctacgattgttccgtcaagatcaaatattacgtatttgtatcccatattacttctccttttattattttatttgttgttttaaatatgataacgctttttgtaactgattatcttcgtcaagcgttaatttacttattgctttgtcgctattagctttaactgtaacgtaaggtgtgataccttttttatgaatttgatgtccttttgggcttaaatattcgtctattgttactgtaattccagaaccgtcattaagaggttttacttcttggataattccttttccataagatttttcacctataatcgtagccatttcattatcctgtaaagaacaagataatatttctgaagcagatgcagaatttccgtttactaaaactacaacaggaacttttgcatattcgtcagtagtatccttttccgtttgagtttccccagatttatttgtcgtagatataattgtcatatcttttttaagtaaaatattagctatatcagtagcttcatttacaaggccccccgggttatcccttaaatcaataataagacctttcatattttcacttgtaaatttgtcataataagttctaaagtcctttgcaacatcacttgagaattcgctgattctaatatatcccatattatcaatcatttttccgctaacgtatgttgctttaactttatctcttgttattgtcatttttacttctttattatttcttaaaacaacaacatctacttttgttccctttttccctcttagtttgtttgaggcttctgatacacttacgtttgatgaatcaaagtcatcaatttttataataatatctccggctttcattccggcttcttcggcaggagaaccttggaatacggaatcaaccaagactgcaccgtcttcattgttcattatttgtaccccgataccgtaaaactcactatcaagctccgaagtatattcttcaaactcttcttcagtataataatttgtatacaagtctcctgtaccctttgcaagacctttaaatgcataatcccataaatcttgttcgtctaattctttataataatcttcctgtattaattcttccagtgcaatcaactttgtgatattttttgcacttttagaacttggagtgtttataagcactttattaccaattgccatattacatgatgccgttacaagaaatgttagaaggtttgttataataagcaaactcataacaacggctattacaataattttacctttattttttttgttttccatatttactttcctttatgtctatttaactactatattatatgtcatcacttttttaatatcaacatttaaaaataaaaacctgatttttaatttttgaaatatacaataatcattttatcactttaaaaatttatttttttctgatacactttattttgataatttataaaaaaggaaatttcaaatggataaattaaatatagttgctacatgcacttttgggcttgaaagagcattaaaaagagaaattatagatttaggatatgatatagataaagttgaagatgggaaaatatattttaaaggaaaccgcaatgacatgatgaaagcaaatcttcatcttagatgtgccgacagagttcttattttccttacaagctttgatgctttttcttttgatgaactttttgacaaaacaaaagattacccttgggaaaacatttttgataaaaatgcaggatttaatcctacaaaaataacaacggtaaaatcaaaactttattcaaaaagagacatacaaaaaataataaaaaaagcaatagtagaaagactgaaaaataaatatcatacaaaaagactaagcgaagaaggagcatattatcaaataatcgtaaacataaaaaaagataaagtaagtttatttttaaatacttccggagaaggtcttcataaaagaggatacagagaaaacgcactaaaagctcctttaaaagaaacattggcaagcggaataatagaactaagcggatatagaggagaccgaccatttagcgatataatgtgcggaagcggaacaataataatagaagcagcaatgaaagcaaaaaacattgctccgggacttaacagacattttgcctttgaaaactggaaagactttaataaaaaagaatttgatctaattaaattacaggcaaaagaaaatattgtacctgctcctataaggctacttgggaacgacatagattacaaagcaataaaagtagcaaatgaaaatgcaaaaaaagcaggtgttgatgatgccgtggcatttcaaaaaatggatatgagagaattcagatcaaagaagaaaaacggaacaatgattgtaaatcctccttatgccgaaagaatcggagaagaaaaagaagtaataaaattatataaagattttggcaaagtatatgaaaacttggaagattggaaattatttgtactttgcgcacatcctcttttccaaaagcactttgggaaaaaagcggataaaaacagaaaactgtttaacggcaacatgctttgttacctatatcaatattatccaaataaaggaaataagtaaaatgataataaaagaagctcttatgaaagcaagtaaaaaacttgaagaaaataatattccaggttcactaaacgaagcaaaatatcttttaaaatttctactaaaaaaagatgatatatactttattacaaatttagataaatctttaaatgacgatgagctaaaaaaatataaagaactggttaacaaaagatgtaaacatgttcctttcagctatattacaggagtaaaggaattcatgggacttgaattttttgtaaataatcaaactttaatacctcgtccagaaacagaaattataacagaatatgttataaataattttaaagataaaaaacttgatattttagaaattggtgttggaagcggatgcataagcatatccatagcaaaatatttaagtaatgtaaatattttaggcgtagatataaatgaaaaagcaattgaagttgccaacaaaaatattaaatataataatgtagaaaataaagttaattttataaaaagcgacttatatgaaaatgtaaaaggaaaattcgatattataatttcaaatccaccttacatcaaaagcgatgttattaaaacccttgaagatgacgtaaaaaaatacgaaccgattttagctttggatggaggaaatgacgggctttacttttataaaaaaataataaatgatgcagataaatttttaaaagataattcctacattatttttgaaataggttacgaccaaggtgaagatgtaaaaacacttttagaaaaaaaacaattcaaagaaatagaaataatcaaagatcttgcaggttttgacagaacaataattgcaaaaaaataaaagacagctaaatgctgtctttttaaaatatcacaaaacataacacttatattaataaaaaactttcttaaatttatagtgatatttttaatcttattcttttcagaaaaatataaataataaaacaaacacattattagttttcttctttcatccaacgtctgccttttttgcctgtcggtggaagtctatccccttgttctatattgactattcttccattttcaatataagaaccgtctttttctacttctctgtattcacctgcaggtaaatcatcagtaccgggtttatataaattactcataatcttttcctttcataatttattctcgatattatttttcatcaatttttgttaattattcaaaaaatatgatgttaaaatttacaaaaaaaaagatatccttaagatatcttcctttcacttttttcttttattattttacaaacgggaaaaataagtccgccaatactattacccaaagttattactaaaattgaaataaaagtattaacattccatattccggcaacagaaaaatagaacatatcggcaatactatgttcaaagccacatagtataaaacccataactccaaatataagccctaaatatttacctatttccgttttattgcttttataaccgtcaactgctatgtaaataagaatattacaaagtattgcaagaataaataagctaagcaaattcccgcttaactttgtattacaaagatttacggcactctcataaagattgacagttgagccaggagtattaaaaaatcttgtaagtttaatcatattagcaagcaaaaatgctccaataaaattgccaatccaaacaattattaaattaaaagcatactttttatcattttcaaataaatacaaaacttttccagtaaataagttaagctcaaaagtacaaacactaaaaagtccaacggaaaagagaaacgcacctattacatggttttccatagataaataagcacatccaccaattcctatcataattcctgctaaaactgcatatataaatacaactaatctacttttactcatttttacctctttatttttgcaaaacaaagttcagtgaaatatcactgaactttgttaattattcttctattatttctattttctttatttttctttcttcaagaggtttatccatataatctgtaggagtttttgcaatttcatcaagaacatcaaaaccttcagtaagtttaccaaaagcagcatattcaccatctaagtgaggtgcattttggtgcattataaagaactgacttcctgcagagtttttatccatgcttcttgccatagatataacgcctctttcatgttttaaattattttcaactccgtttgaagcaaattcacctttaattgtatgcccagggccacccattccattaccgtttggacatcctccttgaatcataaaaccttctattactctatgaaagattaatccgttataaaatccatcttttaccaaattaataaaattttcacatgttataggagcaatattttcatataattcaacaaccattactccgccgttttccatttctattttagcttttgtcataataaccattcctttctttttgtaaggagtattttaccatatatattaaataaataaaacaaatttaaaatttttgtgtacttttttcaacttctttattataatgttggttgggtgattatatggaaaagaaaaataataatgtatctgctttaatccttgcaggaggattaggcacaagaatgaaatcagaaaaaccaaaagttttacatgaaatatgcggtgaaactttacttaaacacgtaattttaaacgttgaagaagcaaatattgacgatataggtgtagtagtaggatacaaagccgatatggttaaagaagttactggagaaaaatacagttattatcttcaagaagaacaacttggaacaggtcatgcagtaatgatggcaaaagactttctaaaaaacaagaaaggtaaaatccttgttctttgcggagatgctcctttaatcaataaaaacgtaataaatgattttataaattatacagatgaaaacagcttggatctttgcgttctaactgcaatattagatgatgcaaaaagctatggaagaatagttagaaaagacgatagacttgaaaaaatcgtagaactaaaagatgcaaatgaagaacaagcaaatataaaggaagttaattcaggtacttacatttttgatgtagaaaaactattaaaacatttggatgaactttcaacaaacaatgctcaaaaagaatattacattacagatatgattgaaatattcaaaaacaacggttataacgttgatgcatttgccgcaaaagaaagcagtatagttgaagcagcaaacaacagatatgagctttcaaaatgtgaggaacttttaagagaagaaataaataaacaacatatgcttgaaggggttacaattataaatccaaaagcaacttacattgacagaaacgttaaaatcggtgttgatacagtaatttatccaaatacaataattaaaaaaggaagtatcatcggtgaaagaaacgaaatatatgcttcaagaatagaaaacagctgtattggagacgaaaataaaatagataactgcgtaataacagatgcaaaggtaagtaaccaaaaccaaataggtccttatgtacatttaagaccaaatgccgatataaaagacggtacaagacttggcaactttgttgaagttaaaaactcaacaatcggaaatggcacaaaagtaagccatttaacatatgttggagatggtgaaatcggagaaaacactaacgtaggatgcggtgtcgtatttgtaaattatgacggtaaaaacaagtataaaacaaaagtaggaaacaactgttttgtaggatgtaatgtaaatcttgttgctcctataacaatagaagacaatgtatatatagctgcaggttctaccttaacagatgatgtggaaaagaactctcttgccattgcaagaagcagacagactataaaaaaagattataaaaaataataaattttagatttacaatttaaaaacatataaaattttgttataatgtgtttataaatagtttaaaactattttaaataaatataatttatggggagtagaaaatgatagaatctttttcagacatttgtttacttgcaggtaattcaaataaggctttagcacaagaaatagcagacaatttagcattacctctatgttcagcaaaaatcggaaaattctctgacggagaaattaatgttacaattaatgaatctgtaaggggaagggacgtttttgttattcaatcggtttgttcgccggttaacgataatttaatggaattattaattatcattgatgcattaaaaagagcttcggcaggaagaataactgttgttatgccatactatgcttatgcaagacaagacagaaaggaaaaaggaagagttcctattaccgcaagacttgttgcagatatgcttacaacagcaggagcagacagagtaatatcaattgatttacatgctgatcaaattcaaggattctttaatataccttttgataggttattcggcagaccaatcattgcaaattacattcaatctcaaaatgaatcaatggaaaatgtagtcgttgtatcacctgatgcaggaagcgtaaaacgttcaagaaaattagctgaagatttaaacgtacctttggcaatcatcgataaaagaagacctaaagacaatgttgcggaagtaatgaatgttatcggtgaagtaagaggcaaaaaagttataatgattgatgatatgatagatacgggaggaactatagttggagctgcaaatgctttagaacaacttggagcagacagaataatttgtgcttgtacacatcctgttttatcaggaccagctgtggaaaggattgaaaattctgctattgacaaattaatagcaacaaatactatcccattaacatctgataagaaaattgacaagattaccgtattatctgttgcaccgctgttagcaaaagcaattaagattatacatacaggtaaatctatcagttcaattttttcataaaaaatataaaacgaaaggaaataaaaattatggatttaaaaacaattgctagtaatgtcagagttggcattattacagaagtagccgctgcacaaagtggacatccaggcggatctttatcaagtgctgatatcgttacatatctttattttgaagctatgaacatcaataaagataatcttgatgatccaaacagagacaaatttattttaagtaaaggacatgcatcacctgttttatatgctgctcttgcagaaaaaggaatcatcgaaagagatgaacttaaaacatttagaaaaatcaacacaagacttcaaggacatccagctattcataaatgtccaggcgttgatatgactgcaggttctttaggtttaggtttccctgttgctgttggtcttgctcttggtaacaaaattgacggaaaagattcaacagtttactgcttatgtggtgatggtgaaatccaagaaggttcaatttgggaagctgctatggctgcaagccactacaaattagataacttaatcttatatgtagacaacaacaacttacaaattgatggacctataacagatgttatgtctccatatccaattgatgaaaaatttgctgcatttggtttcaatgtaatcaatgtagaagacggtcatgattttgatcaacttagagaagcaaacgaaaaagctaaagcttgtaaaggaaaacctagcgtaattgtttgtaaaacagtaaaaggtaaaggtgtttcattcatggaaaaccaagttggttggcatggaaaagctcctagtgaagaacaagctaaacaagctattgaagaattaggaggttggaaataatgagtaaaattgctacaagagaatcttacggaaacgctgtaacagaacttggtaaagaaaatcctaatatcgttgtattagatgctgacttagcaggtgcaacaaaatcaggcgtattcaaaaaagctttcccagaaagacattttaatgctggtattgctgaaacagatatggtttgcttagctgcaggtttatctcttgcaggaaaaatcccattcgtttctacatttgccgtattcggtacaggtagagcttatgatgctgtaagaaacgctgtatgttatccaaaattaaatgttaaacttgctttaactcatgctggtttaacagttggtgaagacggtgctactcaccaaatgttagaagatatcgctttaatgaatgctcttccaaacatgacagttatcgttccagctgatgatacagaagctaaacaagttgtaaaagctgctgttgaaattgacggacctgtattcatgagatttgcaagagctgctactccagtagtattcggcgatgactataaatttgaaattggtaaagctgcaacaattaaagaaggtaacgatgttacattaatcgcttgcggtatcatggttcaaaaagcattagaagctgctgatgaacttgctaaagaaggaatcaacgcaagagtaatcaatatggctactatcaaacctcttgataaagatgctgtaatcaaagctgctaaagaaacaggtgctatcgtaacatgtgaagaacactctatctatggtggtcttggaagcgttgtttctcaagctttaagtaacgaatgcccagttcctatggaatacgttgcagtaaaagatacatttggagaaagtggtacaccagatgcattacttgctaaataccacattgatactccagatattatcgaagctgctaaaaaagctgttggtagaaaataatggacaaaaaacggattactaaagtatccataataactttgattattatcgctttatgtatattcgttatagacaaagtagggtacggtttctttaccgaccctacaaaactaaaggagttcatttccggctttggcatatgggcaccttttgttttttttagtttgcagtttttacaggttattatggccttcattccgggaaatgttcttggagtggtgggaggaggtttgtttggtcatgttaacagctttttgcttaattcaagtgccatttatttgggtagcattgtaatgtttatgcttggaaaacattttagtgaaaaagttgcgttaaagtttgtaaaacaagaaacctatgatcactacttagaaatagtgtccggtaaaaaaggtaaacttacattatttattgcatttttattaccctttttcccagacgatgctttatgtttaattgccggaagcagtaatttaacatataaagagtttcttatttttttatttttaggaagaactccgggaataattttcccaacttttcttggtgcaggaataatgggaaaagattataaattgttagttgcaataagtattgtttatggtattatattatttataatatatttttttagaaacaaaataataaaagatgatataaaagatgagtaaggagtaaagtatgcaaccgtattatatttttgtaacaggtggagtagtttcatcactaggaaaaggcatcacagcagcaagcttaggtagacttttaaaagcaaggggaattaatgtttttattcaaaaacttgacccatatctaaactttgaccctggtacaatgtctcctttccaacatggggaagtatttgtaacagaagatggtgccgaaactgacttagaccttggacattatgaaagatttatagacattaattgttcaaataagagtaatattactacaggtaaaatatactggtcaataatctctaaagaaagaaaaggagatttccttggtggaacagtacaagttatacctcatattacaaacgaaattaaagattttattaaagcagcaggagaagaatcaggtgctgatgttgttattagtgaaatcggcggtacggttggagatatagaaagccagcctttccttgaagcaatcagacaaatgaaaagtgattgcccgggaagagtattatatattcatgttactcttcttccatatcttggaaaagcaatggagcttaaaacaaaacctacacaacattctgtaaaagaacttagaagcataggtattcaaccaaatatcattgttccaagaagcgaacttcctgtaagcgaatcaatcaaagaaaaaattgctttattctgcgatgttccaaaagaagctgttattcctaactatgatgctgaaactttatacgaagtaccaatgtcacttgaagatgaaggtcttgcagattacgtcataaaatgcttaaatattccagcgaaagagcttgatttaagtgaatgggaaaaagtagtagataaagttaaatcaatgaacaagaaagttaaaattgctcttgtaggtaaatacgtaagcttaagagatgcttatttatctgttgcggaagctttatatcatggcggaatagaaaatgggacagaagttgaaatagactggatagattcagaagaaattaatgaatcaaacgttaatgatatacttaaagatgcaaacggaattattgttcccggtggatttggaacaagaggaattgaaggcaaaatgcttgcatgtaaatatgcaagagaaaacaaagtacctttccttggactttgtctaggaatgcaagttgctgttattgaatttgcaagaaacgttcttggcataaaagatgcaacaagctcagaatttgatgaaaacacaaaaaatcctgtaatagatttaatgcctgaacaaaaagatgttgataaaaaaggcggcacaatgagacttggctcttatccttgtgatttaaaagaaggtacaaaagcttatgaagcatatggagaagaacatatctcagaaagacaccgtcatagatatgaagtaaataacgaatataaagacagattggaagaagcaggaatgattatttccggtcaatcaccaaacagactattagttgaaatggtagaacttaaagatcatccttggtatgtagcaacacaagctcatcctgaatttaaaagcagacctaacagacctcatcctttattcagagaatttgtcaaacatgcactaaacaatagtgtaaagtaataaaatcaaagaccgtttaatataacattaaacggtctttttcatattttcatcattaaatactaattttgctttaaataaatctttatcaatggatatagaaaaatcaatattcattaaatctgtaaagctctgtacgattgataaaccaagtccaaatccttccaaatctctggctttatcggctcttgcaaaccttgttaaaatctcttcactcgtaaaattcatttcataatttgaaacattacttatgattatacaaggtttatcctcttcccttttaagatctatatatattcttgatcctgttagagaatatttaactgcattttgaattaaattttcaagaattcttccaagtttttcaccatctgcattaacaacaaagtcatcttcaaaatcaactttaactgttaatccattttcttcgattttatcactaaattctccaatactttggtttattatgctttttaaatttatatcactattgtttaatttaatgtttccgctggaagcttttgatatttcaaaaatatcttctaccagtttttttaatttttgagatttactatccaaaatttctaaatattcttttgctttatcaggcttaatatcctctcttttcattaagtccacatagtttattatagatgttaaaggagtttttaaatcatgagaaacatttgtaacaagttcacttttcattttttcgcttttaacttgttcctcaacagtagttttaatatgatctttaagactatttaaactatattcaatttctttataataactctcatcattcaaatgtatatcactatacaaacttccatcccctaggctttttatataataataaacttcatctatatctctaacgctttttatagaataaacatataacttaacaatggaatataataaatatattaaacaggcaaagaaaaatcctgtcattaaatcgctataatatcccattcctgcaataagcaaaattaatattataaaagatagtcctcccgatataacacatcgtgttatagaacctatcatttttgaacgtacttttttactgaaatttgctctaaccctagttgttttatatgaacttgttatatatttatataaactacaagatataatatttgtataatcatatttaacagcacaaagtgtaagaattgcaaaaataataagtactattttaaattcaaaagcatttatattcattaaaacaaaaagtaaaattaatattcttatttcaataaatatatcattaaataaattacctaaaacttcaaaagtttcctttaacccaaatttatcttttataactttaaataaaacaattgaaagtatcaaaaagaaaataaagttagatatgttcatataggcattttttctataatcgtttaaacttgaaccaaagtatccgtcttcactaaaatcatggcttatggcaacataaacggtaggaggttttacaacatctcttagaaaataattatctgcattattcatatcaaaattatttgaaagattatatgatacacttatatacttttggacattatttatataaacatctgttgcattattggtagtatttatgaaagtatatccctttttcttataattactttcaaaggtttcaagtgatgctaaagtagtatttgtataaatttctccgttattattatcaacaataaaatataaaacctctgccccgtagttttcaattgtgttaagttttattgaagaccttagggtcgtggataatttttttatttcagcatttttatcttttacggaattatcaacatatacttgataatactgataataaatactgttatttaaatttgcatgaagattatcaagctgagatgcatattcggaagaattcaaatatccatttgaatttactacctcataggaacgattactaattatatcagcaaaagaatttatcattatcaacactgataaaaacattattaaacatatagaaacctggctaaataatgttttatcttttctaatatttttcaattttatatccaattccccacaccacctttaaatattttggatttttagggtctatttctattttttctcttatatgtctaatatgaaccgcaacggtattatctgtcatataagaaatttcaccccatacgctttcataaatttcttcgattgagaaaactttattaggtctattcataagtaattttaaaattttatattctgtactggtaagtttaacctcttccccatcaataaaaacctgcgctgtttctgtatttaaacttaaacctcccgtagttaaaatattgctcgtttcagcttttgtcatattacctaaaaccgtatatcttcttattaatgatttaactcttgcaataagctccaatggattaaaaggttttgtaacataatcatcggcacctatatttagtcctattatcttgtcagtatcctctgactttgcggaaagaaaaataactggaacatttttttcttttcttaattttgttagtgttgatattccgtctaattttggcatcattatatccaatacaatcaaatgaatttcttcgttctttactatttccaaagcagaatacccatcatatgcttcaaatatgttataaccttcatttgaaagatatatatttattgcttttacaatttctttatcgtcatctacaactaaaatattatatctgtccattttctatctcctaataaaatcttaataagattataaaacaaaatttttaatattaattatggaaaaatattaatattttattaatattttataattttaagttcaattttaattcactttaattttttttacttttcagctttatttcaatttgaattatttatggtatatattaccattgtaaaattattaaaattcgacaatttaattgataatgtaacaaattatgctataatattttaataaacgtctaataaaacttctttaaaaattagatgtgtatttttggtattcaaaaaaaacaagacaggagtaaacatgattactttaaaagacgtatcgttgatatatgaaggcggagagaaccctgctcttaaagatgttaatatcaacattgacaaaggcgaatttatttttgttataggtaagagtggtgcaggaaaatcttcattaataaagttaattttaaaagaaattgcacctacaacaggtgaaattacagttgcaggttacgatttaaataaacttaaaagcaaacaagttccatttttaagacgtcatgttggagttgtattccaagattacagacttcttgaaaacagaacagtttatgaaaatgtagcttttgcaatggaagttatgcaacataaacaaagtaaaatacaaaaaagagttccaaacgttcttagaatggtaggacttaaagataaagctagaaaatatcccaaccaattatcaggtggagagcaacaaagagttgcaattgcaagaagtattataaacaatcctaaaatacttatttgtgatgaacctacagggaacttagacccacaaacctcaattggtattatgaaacttcttcatgatattaataaaagaggtacaactctacttgttgcaacacatgataaaactatcgttgatgctatgcaaagaagagttatagcattaaaagacggagtagtaattggagacagaaaaggaggatacggccattaaaccatcaactttaaaggtttttataagagattcctttcaaaatataaaaagaaattcattaatgagtgttgcttctatattatcagtagttgccgcacttataataatcggtgtatttttagtatttgcacttaatttaaattatatgacacaaggcattgaagataaccttgaaataaaagtttatcttaatgacaacttaaatgatactcaattaagtcaaataaaaacacagcttgaaagcagtaaactttgcaaaagtgtaacttatgaatcaaaaaatgatgctctaactaatttcaagcaagactttggagataaatcatatctgttaaatggatatgagggcaaaaataatccattacctgcatcttatatagtaaaagttacagactctacaagactaaaagatatgtatgaatattcaaaaaatatagaaggcgtaaaagatgttgtttacggcgaagaagttgttgataatttgcttaaattcaacgacatggcaagtatagtatgcataattatttttatagttttaagtattgtaagtatttttattatttataacacaatcaaactgaccgtttatgcaagaagaaatgacattaccgttatgaaatacgttggtgcaacagactggttcataagatttccattcttaatagaaggaagtattcttggattattaggttcaagtatatcaattttaattataagaaatatttattattatgtggtaggttttattcaaggcggtggtacgggacttcctataggaagcagcatagcacctcctggatttattatgggggaagttacaattctttttatagtatatggaattataataggagctgcaggaagcgctttttcaattagaaaattcttagacgtataaaggagatagacatgaaaaagaagataattcccttaattttggtaatggcttttattactactttggtattttcaccaaatataataaatgcaaaaaccacaaaacaacaactaaatgaagttgaagatgaacttgatacaaaaaaagattcattggaagaaaaagaaaatactgccagcgatttagaaaatcaaattgaaagttatgatacaaaaattgctaagttaacagaaaaaattaatgaacaagaaaaaaataaagaaaatatagaaaaagaacttgaaaaagctcaaaaagagcttagaaaagcgaaagaacaaagaaaagagtatcaagacttactttcagaaagaatggaagtaatgtatatgtatggagataccggttatcttgatttaatattctcttctaaaagtttttctgatttaataagtaaagtttcaacagtgaaatcacttgtaagctatgatcaaagcatagtaaaagaacttcaagaagttgaaaatgaaataaatactaaaacagaaaaaatcgcaaaaaacaaagaagagttggaaaaagtcattgctgacttaacagaaaataaagaaagcttagatacattaagggttgcaaaaaatgcagaacttacaaatgtcaatggagatattgatgatttaaatgctgaaattgcaaaacttgaaaaaaagaaatcagaacttgacaataaaattgctgctcaaagcggttcatcatcaaacaataattataactctggaaccggaaaaggggccctcggatggccaacaccggggaattattatataaccagttatttcggatatagagatcagcctaccgcaggtgccagtacaaatcacggcgcggttgatattggagtaagtacgggaacccctgtattatcacctggaaatggagtcgttacatattcaggatggaacggcggatatggttatgcagtatcaatagactgcggaaatataggaggagatcatattacagttctacttgcacataacagttctttggcagtatcgacaggacaaaaagtttcaagaggtcaagtagttgcatatagcggaagtacaggtatttcgacaggaccgcatttacattttgccgtatattgtaacggttatgcagttgatccacttaattacgtagacatttaaaattataaatataaaaataaaaataaaaaggggttttgaataaattcattaccccttaaaacgcctttaaaagcggaggggaaaaatgttaaaaaaatttatttcttttgcactaattttatcaataatagtttctgttacatttttaccaaataatgtaagtgctaaaactacacaagaaaaattagatgaagttgaagaacaaatcgacaagaaaaagagaacgctaaattctaaagaagataccgctaatattttgataacagaaattggtgattatgaaactgcaataagcgagcttacaacaacaattaatgcacaagaagaaaaacaaacaagtcttgaaaaggagcttaaaacattacaagaagacttaaaaaaagcaaaagataagaaagtaaaatatcaagatttattttctgaaagaatggaaacaatgtacatgtacggaaataccggatatcttgaattaatattttcttcaacgagtttttctgatttaataagcagaatcataacaatacaatctcttgtaagttatgaccaaaatattatttctgaacttgaaaagattgaaagtgaaataaatacaaagacaaatcaagttgcatctgataaaaaagaacttgacacattagtttctaatttagaaaaaaacaagcaaacaatgaacttggttaaagttgctaaaaatgcagatttacaaaatgtaaatggtgatataaacagcttaaagaaagaaattgaaaaccttgaagcaaaacaggaatcttatagtaatcaattatctgccgacagcgcaacagatacagatactgtttatgaagaaaatacaaacagtaataaaaatgatggttccagttcttcgggaagttcttcaagcggaagttcaagcagttcaggaagttcttcaagcagttcaagcagcaagcttttatggcctacaccaggaaattacactgtaacaagcgaacaaggctggagaattcatccaatattcggatatgaaaaataccattcaggaatggatataggtttaagctatggtgataaagtagttgctcccgcaagtggaaaaataacaagagcttctgattatggcgatggatatggaattgcaatatctattgactgcgggaaaataaacggaaaacatgttactattttattagctcataactcaagagccgcagtatctgttgggcaaacagtaaaaaaaggacaagttgttgcatacggaggtgcaacaggatgggcaacaggtcctcattgtcattttgaagttcatgccaatggagtagttcaaaatccaagaaattggttataaaaaaagaggtttaaaacctcttttttttataacacatcgttaaaaactctaagtgcattcctataaaataatttttctatttcgtatatattaaatcctcttttttcaagaataggaataagtattggaacacctgaacaatctttcatttcaagtttacagcttatgccgtcaaaatcacttccaagagcaataacatcgcttcctccaacattttttatatattcaatatgtcttacaatatcttcgtttttgctttcaaaagttgacattaatttatccaaagcatcatagtcttttttatttaaaagagaaaataaactttttttagtttcttcatctatatcccttaaaaataaactataaaaatttatccctattactccccctttatctgcaatttttcttatcatatcatctgttaaattccttgaattattgcataaacttctggcacaggaatgagaagctataaaaggatgtttgcttatatcatatacatcataaaatcctccatcgtttaagtgagatacatctacaatcatacccagttcgttcatatattctactgcttccctgccaaatcttttaagccctaagctttgctccattgtatttggataacctatacagttttcataattccatgtaagagcagccattctaattccacactcataataatatttaatattatcaaaactattatctacactacccatatcttcatttgagagtattatattctgcttattgtcatttatgtgttttatatcttttataaagtttattttttcttcattatcttttatcattctatgagaaaaatctattaactttttatagttatcaattttataatcagatttttctttttcatcaaataatgcaaatacctgaataaaagaatcagcctttttaagtttatttaaatcaatatgtaaattattactatcaaaatctaaaatattttcataatacattttagaaaaagtatcacaatgcaaatctattaacttcatataaccacctttttaatatatattatatttttattgaaatatatgcttatatattatatcattatatctcacataaaacacaaataattacattatcaaaacacaagatgatttgaaaaaaattattaaaaatagtatactaaatctaacgaggtgattatatggactacatgataagaggaaatttaaaaaatagaccaataagattttttgttatttctgcaaaagatacaatagaaaaaatgagacaaatacacgaggcaatgcctaacgcttctgcctgtgcaggaagaagtttaatggcaacggctttaatcggatatacaatgaaaaatgatgacgatatagttactacaattttaaactgtgacggagaaattggaaaagttacttgcacagcaaacaacaaaggacaggtaaaatgcgacataataaatccaaaaacaaatatatatttaaatgaacttggaaagttagatgtaaaaaaagtcgttggtaacgggactttaagggtaataaaagatataggtttaagagaaccttacgtaggagaaacagatattgtaagcggtgaaattgcgcaggactacacttactattttgcaatgagtgaacaaaccccaagtgttgtatctttaggtgtattagttgataaagaaaaatttgacataatacacgcgggagggcttataatgcaattgcttcccggtaatacagaggaagatattgaatatcttgaagaaaaagtttctcatttaaaatatatgactacactcttaagcgaaggaaaaactcccgaagacattattaaagaaattttcagtgatgaagaaattgaaataacagacaaacaagatgttgtttatttttgtaactgttcaagagaaaaaatagaaaaagttgtaatagcgcttgggaaaaaagaacttgaagacattatcgcaacagatcataaaataactttaaaatgtcatttctgcggcaaggaatatactttatcagaagaagaattaaataatttattaaacgaggcttaacatgaataaagctgatttacacgtccatacaataatgtcagacggtatgcatactgtagaagagcttataaaaatgtgcaaaaaaagaggtatcacaactatagcaatcactgaccatgacactacaaaagccttacaaaatatcccttcttcatatgatataaacataataaacggtattgaactctccacaacctttgacaataagagcgtgcatattttgggatactatattaatcctgaagataaagctttaaacgaaaaactaaaatttcttagagaaaaaaggaaaacaagagcaaaaagaatggttgaaaagctgaaagaaattgagaaaataaatatagattatgaagaaataaagagaaaaaatcctaaaagtgccattggaagagttcatatagcaaaagaactttttgaaaaacattatgtcaaaaatattgcagatgcttttgaaaaatatataggagatgattctccctgttttgttagaaacgaaaaacttaccatagaagaagccgttaatttaattaaaaatgccggaggtataagctttttagctcatcctggattaataaaagatatggaaagttatgaagaaattctaaagtatggcatagaaggaatagaagtattctatcctaaacactctgaaaaacaacgtcagtttttttatgatttagcaataaaaaacaaccttctaataagcggaggtagtgattttcacggtcttaaaatgaaaggtaaaaataaacttgccagtgcgtatcttactgataaatatttaaatcaaataataaattaccataataatatttaatttattttaataaggagaaaaataatgttaaatgaattaagaaacatagataagaataaggagtttatcattaatgcttttattaaagctaaaaatttaaaagtaaaaagaataacatatatatcaaatgaaggatatggcagcggagtaaatatatatattgcaaaaaaagataaatctttattgcctgttgaagtctttttaggactttggttaaaaaacacattatgggaagaagaattaaacgactttaattattcaaaaaacgaatgtgaaaccatttttgaggaattatttaaagacatagcaaatgaatatacattaaaaaaattagcacctaaagatgcttcaataattcttgcaaaagccattaaaaatgaacttgacaatattaaaaaggaaaatgttgaagtaaataatcctgaaaatatagaatttttagatgtatcaggtatttatgtgaataaaaaatatacactttctactcctttaattttaagaaatacagatgaaataattgatgcaatagaacttttctccaataatataatgggacaatatgaagaaatgtttttggaaagtaaagaaagatatatatatttcttttaggtaaaacaatgaaaaagttcttatttattttaatgatattatttttagtatgtgatgtaaggaaaccaatttaaaaaattccttgtataaaataaaataaataatcccagtaatattaatgatatagatgaaataagcaggttaaatgctgaaatatttttcttgtaattcataattttctccctcttttttgtattatatcattttatttaccgggattttatattaattattaatttttttatatatgcttttaccgttctttattgtttcaagaacatttatattttgtatttcgtcaatattttttacttttaaaggatttttatccaaaattataaagtcggcattttttccttctttaatgcttcctttttcattttcttcaaaataagaatatgcggcatttattgttgcagcttttaatgcttcttctattgatattttttcttcttctcctaaaataactccattttttgtctctctttttaaagttatccatatacttcttaatatattaggttcaacaacaggtgtatcttcgtgaattgtgtatactacattattttttatagcagatttaataggtgagatattaaatgcacgttttcctaaatttttcaaatgaatatctccgaaaaaatatatatgatccgcaaagaaagatgctatcattccgattttagacatttctttcagttggtcttttcttactgtttgtgcatgaatcattacaggtctgatatttgtttttttatttttaaatgcacttattagctgatctgcagcgctgtctccattgcaatgggtaattatttgaatattttcctttatggctgtatctacaaaatgttctacttcactgtctttataaataggatatcctctgtattctttctcgttttcatatggttttgacatccacgcagttttaccttgtggcgaaccgtctaaaaataatttatatcctcctattttatagcggttatgatattttaaatattctttattttcatctattatttctttacaattttttatgtctacataacttacaacatcaatatcaagcatattttttttagacatttcttttaaaatattaaattcttcatattttgtaagtccgtcttgagctgttgttataccatattgtaaatagattctttctgctttttttattgcttccattaatttttctattgaaatattcatgcatttttttgtgttatctataaaagcactttcttcaagatatccgtttggaataccattttctcttcctatttttcctccaataggatcttttgtatccttatttatatttagtatttcaagtgctttagtgttaacaacacccatatgaccggaagaatgagtaattaaaattagaattagccctttgaaatttcaccaccttccgagaggcgttatcgggtgttattaaacccccgaaaacccttgaaaatacgccaatttatccatgcaaaggtgttatgggctgttatcgaacattaccgcatttttatggcctcacggacgctcgtgagggaaaaattaagggcaaaatacagggaacgacaagagaatgaagtggcaaagagaactgtcgtgatgtgtgccaggctccgccggagccttcccctgtgtgcagccggacaactgaatatagcggctcttgtgggccgatgtattgacggacattagtgtttctgctgatgtccgtttttctatgcctaaaatcagatgcgaagggaggttccgggctgggcctcctttttgtgtctcaatggaggtgagaagcattgagcgataagcccgcgtcacctgccaggggacgaaagaaaaccgccccgcctgcccagcagccaccccaggaagaagtggtggttcgcctgccgctgacggacctttacccattcccggaccatccttttcaggtgcgggacgatgaggaaatgaaagagacaatccagagcgtcaaagagtatggcgtgattgtccctgccatcgtgcggccccgcgaggaaggcggctatgagatcgtagccggacaccggcgcaaatacgcctgtgagcaggccggtctggataccatgccggttctgatccgcaacctggaccgggatgcggccaccatcatcatggtggacagcaaccttcagcgggagaacatccttcccagcgaaagggccaaggcgtacaagatgaagctggaggctatcaagcggcagggcgcacgaaacgatttgacttcgccgaaaatttcggcgaagttgagaagtgatgatgagatcggccagcagatgggggtcagcggcgatacggtccgcaattatatttccctgacgaacctggtcccggagctgatgcagatggtagacgagaaaaagattgccctttcacccgcctatcaaattgcggcgctcaaaccggaggaacagcagatgctcgtcaccacgatagactatgagcaggccaccccgtcactctcccaggcccagcggatgaagaaattcagccaggccgggcggctcaatgaggacagtatgctggcaatcatgtccgaggaaaagaagccggagaagttcagcctgacctttgacggggaccgcatacgcaagtattttccaaaatcctatacgcccctgcaaatggaaaacaccatcatcaagctgcttgaggcatggcagaggaaacgccagcgcagccaggagcggtaaaaccgaatacacctaacccgccggacgatccatttgcccggccttttcattttcacaaggaggtatccatgtatatcaacactttcaaatacacaccggcagatgtagactgcaaactttgcaccgagtatgtcaaaaaatttggctgcaccgcctgcggctgcccctggatggccgagcgcattgaggcgggcgttgtgggctatgcagaggtggtccggcagatgtttccccacgataagcgcctgatggcccgcctggaaccgctgatccgggatttccccggtatgctctggaaggatgagcgccaccggcagcgcatggagggcgtgaaaatccacctgggacacagcaagcgccgggatacacctgccttctttgcggtcatgttcctgttcacttccgatgaggacatttaccgccgcgccggaaactgcctgtgcaggcgaggcgcagagtttgactatgcaaggctccatgagatttcaccccacgattacaccctctatatcgctgcgcggggcatttacactaatgcgggcggcctgacaacccgtgacctggcggatgccgaggttgtggacgctgcggcgctccgcatgatcgtgaacgccctgctcatcgcccggtatggctgtgcggccttggatattcacgaaagggggcgcaaggcatgaaacctctgcatctcccgctggaaggccacgacctgctggctgtggaacggttcaaggacgatacccggcacatggcggaatttctcattctgtccaccccctgccccctggggcgcaggggccagtataagcggctgtttctgaccgaggacgagtatgcccggatgcggtccctggaacgccagggccagcttcagatccgccgccacgctgcaatcatcgaggggcatatcctgcccgacaaacccaaaaaacgccgccattgatggcaggcgtacccataggaggatttaagtatggacgcttatgaagcattgaaagaaacctttgacgatctgtttcagcaggcggttgaggaaggctgctacaccgaggacgaggccaccgagctggtggaaagcctggacatttacagtctgttgcaggtggtccgccataatgccacaacggtgtattcctacatcacccagggcaggcaggaacggtcctttaactaccggggcgaggacctgttccgccagaaagccaccctgctgtatgaggaaaccgaccaggtgacaatggagatcgtggtggctacccgcaccttggagctgtggctcctggaagatatgtccctggcggttgtctcctgcgtgagcgtgaactacgaccatgacggttatatcacgcagtaccgcaccatcaaggatacaccggtcatggacagcgagctgtgcctggacctgggcgagcttgtggaggacttaaacgggctgtgcggcccggtgtatgaacatacccagccggtctatgaaccgtaaccagtaaggcggctggccccagggccgggccgccctttcagaatgggagtgatgaatatggcagtttttcgcgtagagcgcacacgggactacaccgtgatgagcaactaccacctgaaagataccggcctgaccctgaaagccaaggggcttctctccatgatgctctccctgccggatgagtggaattacacaacgcggggcctggcctccatctgcaaggaaagcgtggagacgattggcaagaccctccgggagctggaaagcgcggggtatctgacccgcaggcagcttcggggcaagaatggccggatcaccgataccgagtacaccatctttgagaagccggtcaagccccagccggaaccggcccagccagatacggcttcaccaggtacggaaaacccggatatggtaaatccagatatggaaacaccagatatggctgtaccagatacgggaaatccgccgcaattaaatactaagaaatcaaatatccaaaaatcaaatactcatggatcaaatactcattcattctttccttctgcgcctgcggcggcagagacggacggacagacggaagtaatggaaaaacgagaggaaatcagggatcagattgagtacgagcatatctgcaattccctgaaccgggaacagatagacgagttcgtggaaatcatgctggaagtggcgctgaccaaaagccccaccatcaagatcgggcgggatgcggaataccccaccgcttttgttcagcagcggtttgcaaagatcacctgttcccacatcgagaaagtgctggacggtattcacgaaaacaccacccgcgtctggaacaccaaggcatatctgatggcggcgctgttcaatgcaccgtcctctctggacaaccactacacgatgctggtcaatcacgacctttacggaggcggctcataagggccgccttttctgcaccccggcatggggagaaaggagttttgcatgaaacgcccgcttgcgtatatcaccgcccattggggcgacaacgagtttgagaacaccgaaaacgccgccaaatactgccgcctggtctacgaggccggattttccccggtctgcccgcttctgttccttccgctgtttttgaaggacagcatcccccaggagcataaggacgggatcgacatggcccgcgactatctccgccgcgcttctgtgctggtagtctgcggcggtacggtggatgaggccatgaagaacgacatcgccgtagccgagcggctgcggatcaccgccaccaccctggacggtattttgacggtcaagggccagggccgcgaggatggcggcaaaatgggagcctgacccatgcgggggaaatacctgctccgtcgtctggtggtcccgccttagacggggccgccgctttcatcctgacagaagggagtgattttgatgcaggaagaagtggaaaacaggacattgacgctgacggtcaatgccaccaagttcaccgggcgggtcctgaaagcggcgctttccaagtacctggcccaccgcaagaacaagaagctgcaaaagagccgggacagcccggacgatgtaaagccatacggcaaggtcagcatggaggacctgaaaaagcagtacggcgacatgaaggagatcgacctgcaagacaaggggcttcggagttttgaccggattgcccgcgagtacaaggtccagtatgcggtctataaaacggcaaagggccagtatcagattttcttcaaggctcccagcgaggcgagtatgaacgccgccttccagaagtattccaagaaccggctgaaaaaggagcagcgccgggagtctgtgctgggtaagctcaagaagttcaaggagctggtgaaagccccggtcccgaaccgtgagaaacggagggaacaggaacgatgagacagctcgatttgaaaaaacttctgctccccaacctgccttatctgctgatcggcctatatgctaccaagctgggcgaggcgtggcggctggctccgggcgcggacgcttcggccaagctgctgggcttaatggatggatttgccgccgcttttcagtcagcactccccagctttcacccggttgacctgctggtgggcctctgctgcggggctgccctgcgtctggctgtttacttcaagggcaagaacgccaagaagtaccgcaagaacatggaatacggttcggcccgctggggtacggcggaggacatcaagccgtttatggacccggtgtttgagaataacatcattctcacccagacggaacggctgacgatgaacagccgccccaaggaccccaggacagccaggaataagaatgttttgattatcggcggatctggaagtggtagaaggcccccacctgaccctgcatggggtacgggccgattgccgtcttaaccgaagccagcaagtaagttaagagtatcagcgcggaagaaatctggaagggttttgcagtcctgaccggagtggaaggcccgccttaaaaagcgggacacacgcaacgcatagggcttgagcctgccttgcagaatataacagccccacgaggccgcgctgccggctggcctgccggatacggcagggcaaaaagatatgctatgctgggcgtgaatggacacgccgctgaaaatgggcgaaagctccagaggggctgataaaaagcggcccggtaatcacatcagaaaacacgcttctggttgaaacccaacctgatgcagtgtacttccaagacctatccgacatccttcgtagtcaccgatccaaagggcagtatcctcatcgagtgcgggaaaatgctgcaaaagttcggctaccgcatccgtttcctgaacaccatcaacatgaaaaaatccatgcactacaatcctttcgcctacatccactcggagaaggacatcctgaaattggtgacaacgctgattgcgaacaccaaaggcgaaggcaaaggcggggacgatttttgggtcaaagccgagacgctattgtttacggcgctgatcggctacatccattatgaggccccaacggaggaacagaacttctccaccctgctggaaatgattaatgcgatggaggtccgggaggacgatgaggaatttgaaaaccctgtggatttgatgttcaaggagctggaaagccgccagcccggacactttgcggtacgccagtataaaaaatacaagctcgccgcaggtaagacagccaaaagtatccttatcagcgcggcggccagaacctctatttttgacattcaggaggtccgggacctgactgcctatgacgagctagaattagacaccctcggagatcgcaagacagcgttgtttttgataatgagcgacaccgaggacagtatgaattttttgatcgctatggcctattcccagcttttcaacctgctgtgcgagaaggctgatgatgtgtatggcggcaggctgccggttcatgtgcgctgcctcatagacgaggccgccaacatcgggcagatcccccggctggagaaactggtcgcaaccatccgaagtcgtgaggtatccgcctgcctcgtcctccaggcgcagagccagcttaaagcgatttacaaagacaacgccgacaccatcatcggaaatatggatgccacggtattcctgggcggcaaggagccgaccaccttaaaggagctggcggcatcccttgggaaagagacaatcgatacctacaataccggcgaaagccgtgggcgggaaacttcccactctctcaattaccagaagctcggaaaagaactgatgagccaggatgagctggccgttatggatggcggcaagtgcatcctgcaactgcgcggcgtaaggccgtttctttcggataagtttgacatcaccaaacatccgaactacaaatatctatccgactacgacaagaaaaacgccttcgacatagagcgttttctgtctgccaggctcaaattgaggccggacgaacaatttgcagcctattcgattgacctgtccggggacgaagccgccgaggaaaccggcggctgattaccttcgaggaaaatgtgtgccttccgtaatcaatcaaaaatcaatcaaattttatggaggtacattatggaattctttaactctgctgtggatgttcttcagactctcgtgattgccctgggcgctggccttggtatctggggcgtgattaaccttctcgaaggctacggcaacgacaaccctggtgcaaaaagccagggtatgaaacagctcatggcgggcggcggcgttgccctgatcggtatgctgctcgttccgcagctcaccgggcttttcggctaatctgtcaccccaaaaccccagcccctcccgtcctgtgcgggaggggcagaaaggagggtaaacccctatggattttctgtgggatgccataaccgaatggctcaaggagcttctggtgggcggtattacgagcaacctgtccgggatgttcgattccgtcaaccagaaggtggctgaaatctccggccaggtgggtatgaccccccagggctggaatggcagcatctataacatgatccacaacctttcggagacggtcattgtccccatcgccggagtgattttagcgtttgttatgacgctggaattgatccagatcatcaccgacaagaataacttccacgagatcgaaacagcggtctttttcaagtggattttcaaaacggcctgcgccatcctgattgtcaccaatacctggaacatcgtcatgggtgtgtttgatgtggcgcagggcgttgtcaatcaggcatccggcgttatcatctcggatgcaagcatcgacatcagctccgttgtcactgacatggagagtcgtctgatggagatggagctggggccgctgttcggcctgtggttccaatccctgtttgtgggcattaccatgtgggcgctcaccatctgcatattcatcgtcatttatggtcggatggtggaaatctatctcgtgacctctgtggctcccatcccgatggcggccatgatgggtcgggaatggggcggcatgggccagaactacctgcgctccctgatggccctgggctttcaggcatttctcatcatcgtctgcgtgggcatctatgcggtcctggtggagaatatcgccctggatgatgacatcatcggcgcgatctggagctgtgtgggctatacggtgctgctgtgttttaccctgttcaaaactggaagcctcgccaagagcattttctcggcgcactaaatcgggagggaggtttctaaatggcttatgtaccagtaccaaaagacctgaccaaagtaaaaacgaaggtcatgttcaatctcaccaagaggcagcttgtctgcttcgggagcggggcgcttctcggcgtgccgcttttctttctgctcagagggcctgtggggaccagcacagcggccatgtgcatggtcatcctcatgctgccgtttttcctgctggcgatgtacgagaagaacggccagccgctggaaaaaatactccgcaacatgatacgggtgtgtttcctgcggccccggcagcggccctataaaaccaagaacttttacgccgttgtcatgcggcagaaccagttagacagggaggtgtatcacattgtcaacggaaaagcgaaaactgacccgcaccgagagaaagcagatcgaggccgccatcgccagggcgaaccagaccgataaaaagcatctttcggcgcaggacagcatcccttatcagcggatcttcccggacggcatctgccgtgtcaccgataccttttacaccaagacggtccagtaccaggacattaactaccagctttcgcagaatgaggataaaaccgccatctttgagggctggtgcgacttcctcaactacttcgacagctccatcaaatttcagctttccttcctcaacctgaccgccagccgggacagctatgcgaacagcatcaacatcccgccccagggcgatgtatttgacagcatccgggccgagtacacggaaatgctgcaaaaccagcttgccaagggcaacaacggccttatcaagaccaagtacctgactttcgggattgaggcggccagcctgaaggcggcaaagccccgtctggaacgcattgagacggatgtgataaacaacttcaagcggctgggcgtggtggtggaaccgttaaacggaaaggagcgcctgcgggtgctgcatcagattttccacatggacgggcaggagccgtttcaattctcctgggactggctggccccttccggcctctccaccaaagactttattgcgcccagctccttctccttccccaacggcaagaccttctgcatggggagaaagttcggggctgtctctttcgtccaaatcctcgcgccggagctgaatgaccggatgctggcggactttctggacatggaaagcagcctgatcgtgaacctgcatatccagtcggtagaccaggtgagcgccatcaagaccatcaagcgcaagattaccgacctggaccgggcaaaaatcgaggaacaaaagaaagcggtccgcagcggctatgacatggacatcattccctccgaccttgccacttacgggacggaggcgaaaaagctcttgcaggacttgcagagccggaacgagcgaatgttccttttgaccttcctggtcctcaacaccgcagacagccagaggcagcttgccaacaatgtgtttcaggccagttccatcgctcaaaagcacaactgccagctcacccggctggacttccagcaggaagaagggctgatgagcagcctgcccctgggctataaccagatcgagatacagcggggcttgacgacctcaagcgtcgctatttttgtaccctttaccacgcaagagcttttccaggatggcagggaggccctgtactatgggctgaacgcgctctccaacaacctcatcatggtggaccgaaaactcctgaagaaccccaacgggctgatactcggtacaccgggcagcggaaagtccttctcggcaaaacgcgagatttccaatgtgttcctggtgacgaatgatgatgtcctgatctgtgacccggaggacgaatatgccccgctggtgatccgcctgggcgggcaggtggtgaaaatttctcccaccagcaaccagtatgtgaacccaatggacatcaacctcaactactcggacgatgataacccgctggctttgaaagccgacttcatcctctccctgtgcgacattgtggtggggagcaaggacggattgcagccggtggaaaagaccgtcattgaccgcgcggtgcggaatgtgtaccggccttatctggccgacccggacccggagaaaatgcctatcctgcaagacctctatgacgagctgctgagccagccggagccggaggccaagcgcgtggcggcggccttggagctgtatgtgaccggctccctcaatgtgttcaaccaccgtaccaatgtggagctggaaaaccggctggtgtgcttcaatatcaaggaactcggcaaacaattaaaacagctcggtatgctggtcatccaggaccaggtgtggaaccgcgtcaccgtcaaccgggcggctggcaagaccacccgctactactgcgatgagttccacctgcttttgaagggggagcttgcaagctggagcgtggaaatctggaaacgctttcggaaatggggcggcatccccaccggcatcacccaaaatatcaaggacctgctggcctcccgcgagattgagaacatctttgagaacagcgacttcatctatatgctcaatcaggcatccggggaccggcagatattggcgaagcagctcaacatcagcccgcaccagctttcctatgtgacccactccggcgagggcgaggggcttctgttctacgggaatgtcattctgcctttcctggatcggttcccgaaggacaccgagctgtaccgcattatgaccacgaagccccaggaggtatcggcatgaggcaggaaccccgcttacagtttaccaaagaggaacgggctgccccggcactggaaaagcccatccgcaaggcagaccgggcggcggacaaggcagaaaaagcgcgggcgaaaatccctaagaagaaaatccgcttcgaggaaacggtaacggaccctgccaccggcaagaccgtcacccgcctgcgctttgaggaagtggataagaaaaagccgccttccaagctgtcccatgcagtacgggatgcgcctgggaacgcggttctctccaaagtacacaaggaaatccgggagtccgaggaagataatgtgggcgtggagagcgcccacaagatggaagaagccgccgaaacgggcgggcgcatgattgagagcgcctaccattcccacaagctgaaaccttaccgggaggccgccaaagccgagaaaaggctggaaaaggccaacattaacgccctttaccacaaaagcctgcgggataatccccagcttgccagcaatccgctgtcccgatggcagcaaaagcacgccatcaaaaaacagtatgccgctgccaagcgtgcgggccagaccgcaggcagtaccgccaaagctgcggaacagacggcaaagaccgccaaaaccgccgccaaaaagagtgaacaggcggcacagttcgtctggcggcaccggcggggctttctggtgggcatcgccctggtggtgatgctctgtttcctgctcaacaccatgtcctcctgttccatgatgtttgaaagcgtgggttccggcgttgccggttccacctatccctcccgcgatgaggatatgctgggggccgaggccgcctacgcgcagatggaggcagagttgcaggactacctggataactacgaagccacccatgactatgacgagtatcactttgatctggatgaaatcgtccatgacccctatgtgctgatctccattctcaccgcctaccatcagggggaatggacccttgccgaagtggaaggaaccctctccatcctctttgagcggcagtacattctcaccgaggaagtggtggtggagacacgctaccgcaccgaaacctcaacggacccggaaaccggcgaaaccaccagcgagcaggtcccttacgattactacatctgttatgtgactctggaaaactttgacctgtcccatctacctgtctacatcatgggcgaggaacaggtgagcctctatgcggtctatatggcaacgctgggcaaccggcccgatctctttgagggcaatcccaacgcctccaacagcggcagcctggaatttaccgactatgacattcccccggaagccctggaggatgaaactttccgggccatgattaccgaggcggaaaaatacctgggctatccctatgtgtggggcggcagctctcccagcaccagctttgactgctccggcttcatttcatgggtcatcaatcattctggctgggatgtggggcggctgaccgccaacgggcttttgaacatatccacccctgtttcccgcgagaacgcccggcccggcgacctgatctttttccaggggacctatgacaccgccggggcctcccatgtggggctgtatgtgggggacggaatgatgatccactgcgggtccccgatttcttacgcaaatatcaacacctcttactggcagcagcatttttacacctttgcgagactgccgtaacagaaaggagcttttgtatgaacgccaaaatcaagaaaatcaatgccgagtatgagaagaacgccgcgaaaatcgcggagcttcaggcccggcagaaggaactggacaaacagcgcaccgagctggaaaacctggacattgtgggcatggtccgcagcatgggcatgacgccggaggaactggcggccctgatcgaagcgtccaaaagcggccagatggcccctgccatgacggagaaggaggaaaccggcgatgaagaaaactaaatctcgtatccttgccagctttgtggccgtgatgctctgcttcacggctttttctacggtggcttttgccaatgggaacgacccggaggcaaagccggaaaccacggccagcaccgaacaagccgaggaaacaaagactcccaccaccggcggcatcgaagatactgcggatgcagacgaaaatgcctctgatacggcagaaaccgaaaccatgaccgaggaagatttggccgggctgctttcttccctgttcggctcccaggtggaagtcaccattacggacagcggccttcagatcacttccagcggcgaggcggccagcatcaggaccgggaccgtcactaccaacggcggcaacttaaatgtccgcaccggcgcagggaccgacaatgccgccatcacccagctccccaatgggaccgaggtggaggtgatcggcaccgaaggcggctgggtgaaaatcctcctgccggagcgcgagggctatgtgtgcggcgattacctcaccatcagcgataccagtaccggcgatggcagcttttccctctctcttggagaagatgaactttcttccctgatgggactgcttggcggcgggggcggcagcgccctgaccccggacgggaacctgaccctggttgacgattacggcagcacaaccggcaccggcaagcagtttatcacgctggaaacgaaagccgggaatgtcttttacctgattattgaccgtgacgataagggagaggaaacggtccacttcttgaaccaggtggacgaggcggacctgatggccctggccgatgatggcgaaccggccacctgttcctgcaccacccgctgccaagccggagcggtcaatatgaactgtgaaatctgcgcttcggatatgaccgcctgcgctggcccggaaccagagccggagccggaagaaacgcctgctgccgaggaaaccgagccagagccggaggaagaaagcggcggcatgggcggcctgctgattatcctgctgatcgcggccctggcgggcggcggcgcgttctactacatcaaatttatcaagaataagcccaagaccaaaggcgacaccgacctgaatgattacgactacggcgaggacgaggaacccgccggggaggaagatctggacgaggacgcagaggaagaaatggacgatgagtttactatggatgcggagccggaggatgagaagctatgagatatttcactgacaaccctctggagcgcatgatgatgcaggtcccccgccaggagcgggggcctgacctgtcccgtccggccaaaggccacccctgccacggctgcaaacgctacggggagggctgcatcctgccctgttaccggggcgtgatggaaccggcggcgatgaaacccaaaggaaggagcgtgaacctatgagccgcttagtgattgcagagaagccctctgtggcgcagagcatcgcctctgtgctgggggctgcgaaccgaaaggacggctacctggaaggcggcggttatctggtgagctggtgtttcggccacctggcagagctttcggatgcctccgcctataacccggactatgccaagtggcgctatgaggacctgccgatcctgccggagaaatggcagtattcggtggccgccgacaagaaaaagcagtttaacctgctgaaaaaactaatggagcggtccgatgtgaccgaggtggtgaacgcctgcgatgccgggcgcgagggagagtccatcttccgcaccgtctacaacctgaccggctgcaagaaacccatgctccggctgtggatttccagcatggaggatgccgccattcgggagggcttttcggccctcaaaccgggcggcgactatgacgggctgtatgcgtccgccctgtgccggtccaaagccgactggctggtgggcatcaatgccacccgtcttttcagcgtactgtaccaccgcactttgaacatcgggcgtgtgatgtccccgacgctggccctgatcgtccagcgggaggccgagatcagcgccttcaagccggtcccgttttatacgccggttctggactgcggcggattttctgccgccggtgagaaatgtgccgagaaagcggcggcccaggcggtggcggatgcctgcaaaggccagcccgccctggtccagactgtggagcagaaagaaaaatcagaaaaaccgcctgccctctatgacctgacaaccctccagcgggatgccaaccggcagcttggctacacggcccagcagaccctggactatctccaggcattgtatgaaaagaagctctgcacctatccccgcaccgacagccgatatttgaccgccgatatggaagggacggttccggctctggcggctgcggcggcgaagatctgcggggtggctgtgccggacaccgttctggccgcccaggtatgcaacagcgccaaagtcaccgaccaccatgccatcgtccccaccgagggagctggccgggcggatgtggaggccctgcctgccggggaacgggaaatcctgcgtctggtggcgcgggagcttctgtgtgccaccggctccccttaccgctaccaggaaacggctgtcaccctgtcctgcggcgggaaccaatttttggccaaaggaaaggccatcaccgatccgggctggaaagcctatcagcgggaaaaggtagaccctgcaaaagaaagcgtcctgccggacggactgacagaaggaatgacgctccccgtcaccgctgtcaccatcaaagagggcaagaccaccgcccccaagcactacaccgaggacacgctgctctccgcgatggaaacggctggcgcaaaggatatgccggaggatgcggagcgcaagggcatcggcacaccggccacccgcgccggtattttggaaaagctggtgtccaccggctttgtggagcgcaagaaacagaaaaagaccaccaacctcatccccacgcagattggcgtttccctgattactgtcctgccggagcagcttcaatcgccgcttctgactgcggaatgggaacaccagctcaaagaggtggagcgcggtgaagtgaagcccagcgagttcatggacggtatctgcaatatgctccgggacctggtggggacctacaaggtgattgacggttcccaggtgcttttcccctctgaccgggagacggtgggcaaatgcccccgctgcggcggggctgtcaccgagcgcaagcagggatttttctgcgaaaacgctggctgccggtttgccctttggaaaaacagcaagtttttcacagccaagaaaaagaaccttaccaaggcggtggccgcctctctcctgaaggatggccgtgtgaagctcaccggctgctactcggagaaaaccggcaagacctatgatgcaacggtggtgatggaggacaccggcgaaaagaccaacttcaagctggtgttcgggaatggataagcctcgcatgacggagggccagctccggcgcgcccggaaactgatccgccgcctgtgcgccaactatgatgaaggaaactgcctggccctggatgaaggcgagggatgcgtctgtgtgcagagcatttcctactcccttctctgccggtattttaaggaggcggttctgcctgcggatgcggagctgtgcgcggccatcggccagggagccgatgatctgaaacgctgccgggcctgcggcaagcccttccaggccagaagcaatcgggctttgtactgtccccgctgcgccgcttttgaacagcggaagaaaacccgtgaacgggtgcgccgccaccgggggcagatgtaacgctttcggggccggaaagcccaggtatttcaaggcatttccggccccgtttgtgcgttgccgtatgttttcccctgaacccctcaaaaccgtgtttgaaaccgttacatttccgcccccgcaagggatgagttttcttcccctgcgggggcctattttttcaggaaaggagctgaactctcatggccgataagcccaccaacaaggaacgcctgaaagaactgggtgagaagatcgaggcaggcatccgggaagtgtttgacagcggcaagtatgccgagtatctgaaagtcatgtcccgctttcccacctactccgtcaacaaccagatgctgatccgcttacagcgccctaacgcgaccaaagtggccggttataacaagtggcagcaatttgagcgccatgtaaagcggggcgaacatggcattacgattatcgcccccacaccctacaagaagaaaatcgaggaacagaagctcgacccggacaccaaggccccggtgctggatgccaacggcaaggtagtgatggaggaaaaggaaattgaaatccccacgttccggcccatcaaagtgtttgactacgcacagaccgagggaaagccgctgccccagcttgccgccgacctgttcgggaatgtccagcattacgaggctttcatggaggccctgcggcgcacttcgccagttcccctgaccatcgagccgatgcaggacaacatggacggctttttcagtcccaccgcccagcgcatcgccatccgacaagggatgagcgaggtccagaccgtatgcgcctgcatccatgagatgacccatgccaccctgcacaactatgaaaagcagcggatggaggccgctgccggggacccgtccaaggagccgccaaagcccaagccccaccagattgaggaaatcgaggcggaaagcacttcttatatggtctgccagtatttcggcatcgaaaccggggagaacagcttcggctatgtggcctcctactgcaaagaccgggagctgtcggagcttcgggcctgcctgaataccatcaataaaaccgctggcagcatgatcgccggtatcgaaaagcactttgccgaggtctgcaaggaacagggcattgacctgtccgagcagaaaaatgagccggagcagacggtcccggctgcggaagaaccggcagcggaggaacccgctgcgccggagctggaccccatcgaccagcttgcctccgacatcgaccagtttgcctttgatttcgacccttatgaataccgggaccaagtggaggaccgggaggctgcggtgaaggacctggcggcttctctccggcatggcggggcgcgaggtgttcaggactggctccaaagcgtcctggatgaaaacgaacccggtgaagataccgcaaaggctgcggagctgatgcagcggctggaccagcttgcgcctgtgcaggaaaagctgctgcttctggatgaggcggtgtatctgcatctgcaaaccaccgaggatggctatgactacactctctatgataaagacaccctccgccagatggatggcggtcagttggacgcgccggagctgcccatctccaccgccgccctggaaatctgtgagatgcacgacctgggaggccagtccatcaagtatgcgccccttgccatgattgaaactttgcaggaggcggcctaccggcagatgcaggaggcagcgacccaggctgccgtcccggaaagtaccatgctgccggatgccccggagcagacgctggatgagtaccccatgccggacccgatgctcacgctggatgatctggaaaagtgcggctaccgggacggggatatgctccccctctccaaagagcgggcgatggagctttatgagcgggatctgaccgtgtatgcggtggtggatggcggtagcgcggagatgctgtttgaccgggaagaatttgacacccaggccgccgggaccatgtatgccgtttcccgcgaggaatgggaggaaagcccggagttcgatgcgcgggtgcagaaccgcctgaaccaccaggaagaacgggaacgggcatttctttcccatgagggggactgcttcgccatttaccaggtggccgagaatgacccgcagaggcttcgttttatgaatatggactggctgaacgcccatgacctttctgtggagcggggcaactatgatctggtctataccgccccgctcccggaaaccggcagcatggacgggcggcttcacaagctgtttgaacagttcaatttccaccgcccggcagacttccacagcccatccatgagcgtcagcgacatcgttgcgataaaaagggatggcgtggtatcctgccattactgcgacagcgttggctttcaggaaatccccggctttcttccgtccaatccgctgaaaaatgcggaaatgaccgttgaagatgattacggcatgattgacggcatcatcaacaacggccccaaagcaacggtggcggagctggaggcgcaggcaagaagcggacagcccatttccctgatggacctggcagatgccgtccaccgggaggaacgggacaagaaaaaatctgtgatggaacagctccggcagagtccgaaacaggagcggaaaaagacagcgcccaaaaagagcgcggaaagggagctttgatatgaacaactttacctttgaagaaatcaacctgatgtgcatttacaattccggggacgggacccgccaggagctgatcgaggccctcaccgagatgcgcggctacctgggcgcagatgaaacggagcttttggagcttaccgactctgctctttcaaagctgtccgccatgaccgatgaagcatttgccgagctggaactgtacccggattttgacagcgaggacaatgcctatgatgagtaacctggaattttattctgcgatggccagctacaccgccacccatctgacggatagctggcagaggtggaccgcatttctcaccaccgcctcccggctgtataagtaccccttccacgagcagcttatgatcttcgcccagcgcccggatgcaacagcctgtgcggaatatgacctctggaacgacaccatgcgccggtatgtgcggcgcggctccaagggcatcgcccttgtggacaattcccgcgaaaagccccggcttcggtatgtgttcgacatttccgacaccggcctgcggaaaaattcccgccaccccttcctgtgggagcttcgcccggagcatgaggcggcggtggctcaggcgcttgccgagcggtttggtgcgccgcccgaaaacaacctggcggaacagcttgaaagcatcgcggcccagcttgtcagcgagtattgggtggaacacaagcgggacatcctcgacatcgttgacgggagctttctggaaggctatgatgaatttaacatcggagtgcagttcagaaatgccgcaacggtcagcattacctactcgctgctgtcccggtgtggactggagccggaaggctacttcgaccatgaggactttttaagtatcttcgatttcaacaccccggaggcggtagctgccctgggaacggcggtcagccagagcaaccaacaggtgctgcggcagatcggcattactatccaaaactatgaacgagccaaattcgcggaaaggagcgtcacacatggagaacaacctgacttacaccaagaacggagattatctgatccccgacctgaagctggaggaaacgaagcccctgggccggtacgggaggatgcgccgggattatctgaaggagcatcggccggtcctgttcaacgccatgatggtgagcgggaaattgtacccgcacttgaacgagatcgagcagaccatgaaccggcggctggagcagatgatgccggagctgatgcaggcggcgggcgtgacggaggaactgaaagcccgcgatccgatgacctgggtggggctgatgaacaactgcaaagcccaggcggaggaaatccttctgacggaacttatatacagctaaccctgtttccctcggaacaggaacaaatacggcggattgatgaagggccaggcgttttcgcgtctggcccttctgctgtcccggagccggaaccggccccgccaacaccagcggtccctcgccgggcgcttacccaggctgacattgatgccgccatccaggaatggaacggcaatatcgagagcaagcacgcggttgtccgctacatgaaggaccatgcccgtgaaaaggacaccgctacttggctgcggcaggaatacggcgatgcgctgcctgcctttcctgtcacggcggatggcgcggcgggcgatgtgccgtggcccaaagtgcagcgccggatcgcccagctcattaaggaggaccgcttctatactcaagaagaacaggaccgctttgacaacatcgaccctatcgccatccgggaggccctggccgagcgcgggattgtgaacggtcaggtggcagacccggaaaagctggacaacgacctgttcatccagcaggtgatgcaggatgtggaggctgtcgcagccgaggaacacgccgagccggagccagagccgcctgcgccggacttatccggccagcctgtcacccgcgagggagacaccatcaccattgggaatggggagccgacccatgagatcgacattaccgtttccgatgaggaatacgaggccatccagcaggccatcccggagaaaaaggtctatgacccctccgcaccggtctaccatgtaggcgatatggtctatctggacaatcaggaataccagatcacagagctgcgggaggatacggtacagcttcttcccgctggcatggcttacccgatcttccgggccgagagccgggaacggtttgagcagcttctgaaaaacgacctgcgaaacggccccattaccgagttcctttctgctgacccggagaaaacggaccaggacctgcgggaagtgctgacttccgggctgtttacctggcaggacaaggagtacatttcccgctggctgcgggatggcgagggcaataccaaaatcgcccagcgcctttctgagctgtattccgggcgcgtggagacgatggactttgtgaccggggatatagcagactaccgcaccttcaccaccagcgttgaggtggagatcctggaccatgaggaacgaaaacttgcgaccctggcataccgatgggatgaactggctccgcttcttcggggaatgtatgtaaaggagctggacggcttctttcaggacccggaaggcttcgcagaccggcacacatccccattggaaggaactccatcttaccaggtgggcgatcaggtaacgctccctgcgcctgaccaccccatcaccggcacgattgatgccattgaagatacaacggtccgcatttataccgggccttatgcctggagctatgatgtcatcagccgggaacagtttgaaacctggctacgccaggatgagcgaaacgccggactgttcacgcaggaggaaaaagaaccccctgcgccggaaatcacctccgagccggtaacggtctatccgggggacaaaaacggacttccctatgatgtggtggtggaacggctgcacatagacgagccggaacccacgccgccggaaccggccttttctgcggagcaggctgaccatcaggaaaacacggaccagccccgccgaaccgggcagaacttccacatcacagacgaccacctgggggaaggcggaccgaggctcaaatatcaggccaatatcacggccatccggctgttgaaggagcttgagactgcgggccagcaggccagcccggaacagcaggaagtgctgtcccgctatgtgggctggggcggcgtgccggaggctttcgacccggccaaaaccgcctgggccaaggagtatgccgagctgaaggagcttttgaccccggaggaatacgaggcggccagggcctccaccctgaacgcccactacaccagccctatggtgatccgcgccatttatgaggccgtggagcagatgggctttcacagcggcaacattctggaaccgtcctgcggcgtgggcaacttcttcgggatgctcccggagagcatgagcgaaagcaagctgtacggcgtggagctggacagcatcaccgggcgtatcgcccgccagctctatcccaatgcccgcatcgaggtcaacggctttgagaaaacgcagtaccctgatggcgtttttgaccttgccatcggaaatgtaccgtttggcaactaccgggtgagtgaccggccctatgaccggcacaatctgctgatccacgattacttctttgccaagaccatcgacaaggtgcgggctggcggcatcattgctttcatcacttccaacggcatcagcggcggcacaatggataaaaaggacgcgcacgccagagagtatatggcccggcgctgcgacctgctgggcgcggtccgcctgccgaacaccaccttccgggccaatgccgggacagatattgcgatggacatcgttttcctgcaaaagcgggaggttccccggatgcagggagagccgctgccggaatgggtggagacagacctgttacgcacaaacacttatacagataaggacgggcgggaacggcacgaccatgtgaccatgaaccgctacttccgtacccacccggaaatggtgctgggcgacctggatattgtgaccgggccgtttggcccccagctcgtctgcaatccgagggaaggcgcagacctggaacagcagctccgtgaagcgatgcagcatatccagggccgctataccgaagccgcgctgccggagctgggcgaaggcgaggacatcgacacctccctcccggcagacccggatgtgaaaaactattcttacacggtggtcgatggcgcggtgtactaccgggaaaacagccgcatggtgcgccctgacttaaacgctaccgccgaggcccgcatcaaggggctggtggagctgcgggactgtgtgcagcggctcatcgacctggaaatgaacgccgccatgccggatgccgctatccgggaacagatggcggagctgaaccggctctatgataccttttctgccaagtacggccttatcaatgaccgggcgaaccggctggccttttccgatgacagcagctattacctgctctgtgcgctggaagtgttggacgaggatggcaggctggaacgaaaggcggatatgttcaccaagcggaccattaagccccatgaggcggtggcctccgtggacaccgccgccgaagccctggcagtctccatttcggagaaagcctgtgtggatatgggctatatggcttcgctcaccggcaggaccgggaacgagctggccgaggaactgcggggcgtgatcttccaggtgccggggattacggagccggatggaacaccccattatgtgaccgccgatgaatacctgtccggtaatgtccggcagaagctgcgccaggcacagcgggcggcggagcgcgatccggcgttttccatcaatgtggaggcgctcactgccgcccagcccaaggacctggatgcctctgagattgaggtgcggctgggtgcgacctggattgataaggaatacatccagcagtttatgtacgagactttcaagaccccgccctatctgcgggatgtgatcgaggtgaagtatgtcccttacaccgccgaatggcaggtgacggggaaaaactctgtgggctacaacaatgtggccgcctacaccacttacgggaccaaccgggccaacgcctataaaatcctggaggacagcctgaacctgcgggatgtccgtatctatgacacggtggaggatgcggacggaaaagagcgccgggtgttaaacgccaaggaaaccactctggccgcgcagaagcagcaggccatccgggaggcatttaaggactggatttggaaggacccggagcggcggcaggcattggtccgccaatacaatgaagaaatgaacagcacccgcccccgcgagtatgacggcagccatatcgtctttggcggcatgaacccgtccatcaccctgcgggagcatcagaaaaacgccatcgcccatgtgctgtacggcggcaatacgctgctggcccatgaggtgggcgcgggcaagacctttgagatggtggccgccgcgatggaggccaagcgcctggggctgtgccagaaatcccttttcgtggtcccgaaccacctgaccgaacagtgggcttcggagttcctgcggctgtacccttcggccaatatcctggtgacaaccaaaaaggacttcgagaagcacaaccgcaagaagttctgcgcccgcatcgccaccggcgactatgatgccatcattatcggacactcgcaatttgagaaaatccccatcagcaaggaacgccaggagcggcttttacaggaacagatatgggaaatcaccgagggcatctccgaggtggagtccagcggcggggaacgcttcacggtgaaacagttggaacggaccaagaaatccctggaggcccggctggaaaagctgcaagcggaaggccgcaaggatgatgtggtaacttttgaacagctcggcgtggaccggctctttgtggacgaggcgcacaactacaaaaacctgttcctctataccaagatgcggaatgtggcgggcctctctactacggacgcgcagaaatccagcgatatgtttgccaagtgccgctatatggatgagatcacgggcagccggggcgttatctttgccaccggcacgccggtttccaacagtatgacggagctttacaccatgcagcggtatctccaatatgaccggcttcaggagctgggcatggcgcactttgactgctgggccagccgcttcggggagacggtgaccgctttggagcttgccccagaaggaaccggctaccgggcgcggacccgtttctccaagtttttcaatttgccggaactgatgaacctgttcaaagagatcgcggatataaagaccgccgaccagctccatcttcccaccccggaggtggaataccacaatatcgtggcccagcccaccgaacaccagaaagagatggtgaaggccctctccgagcgggcggccaaggtacacggcgggagcattgaccccagggaggacaatatgctcaagattaccagcgatggccgcaagctggggctggaccagcggatcatcaatccgctgctgccggatgagccgggaaccaaagtcaatcaatgcgtggacaatatcatgcagatctggcgggacgggcaggcggataagctgacccagctcgtattctgcgatatttccacaccccaggcaagctccgccagaaaggtggcgaaggcgctggacaatccgaccctgcacgccctggaagatgcggtgccgctgccggagccggaaccggcctttacggtgtatgaggacatccggcagaagctcatcgcccaggggatgcccgccgaacagatcgcgtttatccatgaggccaatactgaagtgcggaaaaaggatctgttctctaaagtccgtaccggccaggtgcgcgttttgctcggcagtacccaaaagatgggggccgggaccaatgtgcaggatcgccttgtggcgctgcatgacctggactgcccctggcggcccggcgacctggcccagcggaaaggccgcattgagcgccagggcaaccagaatgaaaaggtccatgtattccgctatgtgaccgaggggacctttgatgcctacctctggcagacggtggagaacaagcagaaattcatcagccagatcatgtcctcaaaatcgccggtgcgaagctgtgatgatgtggatgaaacggcgctctcctttgccgagattaaggccctttgcgccggggacccccgcatcaaagagcgcatggacctggatgtggatgtgtcccgtctgaagctgatgaaggccgaccaccagagcaagcagtaccagatggaggataatcttctgaaatacttcccggagcagatcgaaaagcacaaaggcttcattaaggggcttgaggcggatatggaaatactggccgcccatccccacccggaggacagctttgccgggatggaggtgcggggcgatacccttaccgacaaggagaatgccggtgccgcccttttagacgcctgtaaggaagtgaaaaacgccgagccggtccaggtgggaagttaccggggctttgtcatgtcggtgtcctttgatgccttccgccaggaatacaccctgcaactgaaaggccagatgacccatcaggccactcttggcgtagacccgcgcggcaacctgactcgcattgacaatgccctggcgcagatgccccagcggttggaaagcgtgaaagcccagcttgataacctctaccagcagcaggccgccgcaaaggaagaagtcggcaggcccttcccctatgaggatgaactgcgggagaaatcggcccggcttacagagctggacacgctgctcaatatcgacagcaaggcccccggcccccaggaaaccatcgttgccaaaagtacacgcccctccgtcctggaggggcttcgccgtcccatgccgccgagagcggcagacaaaaaatccaaaaaccatgaggaggtgcgataactatgacacaggaagaaatgctgacagccctttatgaaaagatggctgctgaacaggacaagtaccgcgactggctgaaaaaccagcctgcggcggaggtcttaaaccatgcctacgagtacacggtccgggaggacatcgtgatgtgcatggaggaattggagctgaccgaagcccaagcaaaggcgcttctggcttcgcccgcgccgctggccgatgtttacaaggactttgagaagctggaaaccagctacatggatgtgatacgggacaccatcgaaaccagggcaaacgagctgtatcaggcccaggaaacactgaaaaatacgcccctctatccccattcggcggcgtatgcgtccgagcatggggagatggcacaatacaacgcctcgtttcaggcaagccatgcctgcaaggaggccatcgaacaggcaatcggccgccattacagcaataaccggctggatgccgaagccgctgtgaacgatgtattagaacagttcggggcggaccgggtacagtatgtgctggccaacacggtccggcataaggaatgggatgggcgcatctcccgcgacaataaggcatgggccagcacgatgcccctgccggagggcagcccccaggaccggcacagcgagtatctggtggtggaccgctgcaatcccggtctgaccgacctgtttctgaagcaggtgcggcagcttgccggagaacgagaaaaaccctctgtccgggagaaactgcaaaaggctccggcggctccccggcgctctgccccagccaggaagaaagaggcggagcgttgatatggcgaaccgggaacgggaaatccaactgaaattccgcgtcactccagaggaaagggagctgatcgaggcaaagatggcccagctcggcacacagaacatggcggcctatctgcggaagatggccctggatgggtatgtggtccgtctggaactgccggagcttcgggagatggtatccctgctgcgccggagcagcaacaacttaaaccagctcacccggcgcgtccatgagacaggacgcatctatgatgccgacctggaagatctacggcagggacaggaaaagctgtgggaggcggcggaacatatcctctcggcattggcggccctgaaataagggtgcgggcggcggccagaactttggcttgccgcccctctttcttttttggccgcatccttgcaaaaagaagctggggccgctatgctgaaatcagaaacgaaaacagcgcacgaggtaaaggagctgattgcgatatgctgacacatgaaaaagtgctgaaggtgttcggcccgtatctggatgctgaccctgactatgaggtggtaaagaccagccggggctatacgctgctggcctggaacaaccgccgggaggaatggttcagcgccgagttctgcaagaccccggaggacctgcgggatgccctgttagatgcctatgtgaattacctggaatatgttgtcaccgatgaggaccgggaccccaccgagcaggaaatgcgggaaatccaaaagaagcggcaggcgatgtatgaggaatgtatgaaggagggactgtgatgagactgattttgaagattttggccgcgcccctggtggtcgccctgaccctgttcgtctggatttgtaccatccttttgtactgcaccggcatggtccttgggctggccgctttggtagtcgcccttttaggggtggctgtgcttgtaacctactccctgcaaaatggcatcatcctgctggtgattgcctttcttatcagcccgatgggactgccgactgcggcggcttggttgctgggaaaggtccagggattgcggtatgcaattcaggaccgcatttacaggtgaacgcgccgcccggatatggtataatcggaacatggaaaggcggtggcgtcatgggggccagcaacaaggtctgcccggtctgcggcaggaaaatgaaacagcagttcatcggcttgcagcactgtaaatgcggcatgagctggaaaaaggacatcggattttttgagcgcaccagcgacatggtgtttgctctggaacggcggactgtggggaaaaaggtaaaacaggttcccgtgatccggcgcaaagactgaacagaataccatcaacaaaggcggcctgcagatgcaggccgccttgattatatcactttgaatgaatagagacattattttttccactttttagaagcggagagaaagacagtgttacctcataaccttgcattggcgcactatctattttcatagaaccatcatgcgcctcaacaatttgacgcacaagcaaaagccccagtccatgccgcaaatcaagtcgttcatcggtgctttccatatagtggggtttttcctctaattcttgtaacttttcaggggtaagccctactccattatcagcaacagatagagtaagcgtttcttcggtgtatttaagggaaagcaggattttgcaaccttgcggattatgcttgatgctgttctgaacaaggttgttgattgcccgtgaaatcaagcgtgcatcacattccaacatggcattttctgcttctggtgcaatatcaatttcaatcgtataggcatcagaaatcccggagttgagcaattcggctacataggaacgaatgagtttggacaggcgtatctgctccttgtgaagtggctgcatttcgtattccagttgggatactaaattcaaatcctgcacaagttctttgattttgacgctttgctttcgcacgatttcggcctgttctctaaccttatcagtggttgcttcatttgcggctatccgaccagcatatcccataatcatagaaagcggtgtacggatgtcatgggagacgccgctgatccagttggcgcgggcttcgttctgcctgcttattatctgagaggctttatttacactggctgcaatttcggatagctctccgtcaatatggagcgaagcgggtttgccatctgccaatgtttcaatggcttctacaatcggctctgtattctggatgatcctgcgttttgaaaagtaataggccaaaaacaggcacagcgcatccatgcctaacattcccatcacatagaaagggattttttgaattgcctcaatggaatagtagttgctggtgatcttcatgtagctatcctttggataccccaaaaccaacaagccctcgtccgtattccagacaaaaacaggataatcttccagataaccttttgaaaacaaagctacatcctgaatgttgtaatttcgcggcacttcttctggcacatcgagggtccaaaagcactttccatttggtgtcaaatacatagcccagatattgtactgacgcaatttctgtaccgcatcatccgtcaggccctctgtggttgccgcagcggaggccatctcaagcatagcgcgtggggacgcttctccgtaatcctctgaaactgtgtgatagaaggtcgctccaaacagaataatattgataagcaccagtatcaggagaaacgcagcgaaagacgccaaatgttttgaaatatatgttccaaaagatttcatggcgtcacttccttgtaatcagtttatagcccagccccttgatcgtaatcaaagaaaccggctttgatggatcggcttcaattttttcccgaatacgccgcacatgggcattcaggctgttttcatagccgaaagggttgtcaccccataacgcttcacaaagagcgtcaagcgtgacgatctttccctcattgcgggccagcgtttccagcagggtatgctcttttgcggtcagggagataacctcgccccctttgttgacctctgcccgactaaaatcaatcgtacatccatccaggataaccagcgggctgtcctctttataagtgcggcgcaagaccgcatagacacgcagcaatagttcctgcggcataaacggttttgaaatgtaatcatccgcaccaaggccaagaccggccagcttgtctgcggcttcgtcttttgctgttaaaaagattaccggcacatctgtaaatgtacggagctgctccatcagggaaaaaccgtctccatctggcagcattacatccaatatcatcaaatcaggtttttcctgttttgccaccatgacggcttctttcacggatgcggcagcaaggacggcttcaaaaccggcatccttcaaaatatctgataccattttcagcaaatccggctcatcatctacaagcaagagcttttttcgatgcagaaaagagttatccatagcttcacctcctgaaattattatagcacaggatgactagcctgcggtgggtatcccgaaaaagtaaggtaaaagtaaggacgcgagaatgtagaagtcaggttaatgttttatgatggagtcaatgaaaggagatgttcttatggattacattatcactacggaacagttgacgaagaaatataagaacttcacttctgtcaaccatgtttcgcttcatatccgcaaaggcagtatttatggttttctcggcccgaacggagcaggcaaatccaccactatgaaaatgctgctgggcctgacagctcccacaaaaggcagttttaccattgatggaaagcaattcccggctgaccggattgcgattttgaaggaggtcggctcgtttattgagtccccttcgttttatgcgaacctgactggccgggaaaatctcgatattatccgtaggattttgggactgccgaaaagtgctgtggaggacgcactggaccttgtgggcttgacggaatttggtgacaggctggcaaagaaatattcgctgggaatgaaacagcgtctcggcctcgccggtgcgctgctgggcaggccccctatccttattttggatgagccgacaaacggacttgacccttccggcatccatgagatccgcaacctggtgaaatctctgccggatctgtacgactgcacaatcctgatctcgtcccatatgctgtccgagattgagctgatagcggatgacattggcattctcaatcatggccggcttttgtttgaaggaagtctggatgagcttcgccaaagtgctttacgggctggttttgcggcggacaatctggaggatatgttcctctcgatggtggagaaagataacgcggccagaaagcagagggcacagctatgaatgtactgtcaatcgaacttcggaaagaaaagcggaccggcgtcattcctgtgttgctggcggttggagtgttaggagctgcatacgcatttgttaatttccttgtgcggaaagatacgcttttgaatttgccgctggccccgatggatgttctgctgacccagctttacggtgtgattatgatcctgaacctgttcggtatcgtggttgccacctgcatggtctacaacatggagtttaagggcagcgccatcaagaagatgtatatgctccccatgagcgttccggctatgtacctgtgcaaattcctgattctgacggtcatgtttttggttgcaatcgtactgcaaaatttagcacttatgcagatcggcatgacagatttgccggaaggagcatttgagatgggaacactggtgcgctttgccggatattctttcctcacatctatgccggtgttgtcgtttatgctgctgatttcttcgcgctttgaaaatatgtggatacctctcggtgtaggggtcgcaggatttttaagcggtatggcgctggccagttcaaatcttgctgtcctgatggctcatccttttgtgcttatgctgaaaccggcagttgccatgagcgcccagcccgatatgactgtgagcgcggtatctttgatggagactgttttgttccttgctattgcactgtggctggcgaaaagcaaacgctatgagtaaggagggattgagaaaatgagctttttggaattgctcagaattgagtttatgaaggtgaaacgctcaaagatcgtaccactgatctttatcgcaccactgttggtggttgcctccggggttgcaagcctgagccgctatttcaccccggaatatacaaacgcatggcctgccatgttcattcaaagcgcattggtttatgcgtattacctgttgccgttcagtatgattgttgtctgtgtgatgattgcaggccgggaaaccggtaacaatggcatcttaaaaatgctggcgttgccggtcagccgatacgcgctttcgattgccaagttctgtgtgctggcattttacctgttcatggaaatggtggtgtttcttgcagtgtttgtaattgcgggattgattgcgacacagacgatgggagtaacagaaaccttgccgatcctgtatctgctgaaatggtgcttggggctgtttctgacaatgctgccgtgtattgcggctatgtgggcaatcacggttctgtttgaaaagccgcttctttccgttgggttgaatttgctgcttgtaattcccggtatcttggttgcgaatacgccgctgtggattgtttatccgtactgttacagcggttatctcgtttcctgctctctccatgattttacagcagaagcttccgacgccgctttttcgatgtttccgttcctgccctgcgcgattatagtgttcggtctgtttttcgcgttggccgtcacccgatttgggaaaaaagaaatgaggtaaatactatggaaaagaaaaaacttcaatcaatcagtatagctgcgctcattgtgagcatcctgccgctggcggcccttattccgtcatttctgcacctttcgctgtcggacggcatccgaactgtttgggccggagccaatatcgtttttgttctgctgggcctgattctttcggtaatttgtgtgcgtaacagggaaagccgtagcgttatcaatatcgtatcaacagcaatcagtgctttttggttgttgctgatggtgggaattgttgcactcgctttgttccttactttcgttcagtgaggaaatggttatgcacaaaattggaaaaatctttggatgttgtctgattgctgttactttgctggcctgtactgcctgctctggcctcgatagattaagcgaaaatctaaaagacggagcaacgcagctaagtgacgatgtggtgatcgggaaaagcaacgcgctcataacgccttatcagtcctttgagggcagtcgtacttcggatagttatgcttttcaagctacttatgacgcttctgtaatgggcttcgatggacaggatattttggtagcggataccgacctcaaagaaaatgagtgccgggaaatcaccatccagtatagttttgatgttcaatctggaaattgccaactcatttacatttccccggaattagaggaaaaagtgctttctaaatccgacagcggtagcgttaccgtccaacttcaagcgggagctaactatattgggatcaccggcacagactattcaggcgctatccagattgatgtggaatagacggtagaaagttatgaaacgactattagtagtggacgataatacggaatatctgcaattcctgtcatccgtgttatcaggtgattttgatacgattaaggctacgggcgtcaaggacgcattggatattcttcaagcgattacagtagatgcgatatgttccgatttcaatatgaaagacggcacaggattggatttgcttgaagatattcgtcaacgagggatctccgttcctttcctacttatgtctggcaatgacgattacctgcttgtacaacagacaaaactttatggcggcgttttttgctgcaaaaccgattatgatttgattgcgaaaataaaagcactgaataaccccgaaccataatgctctatcatctgccggacgacggcaaaagaaaaaaagccgtcgttcagcaggcaatcatcatgccatcattatatatcacggcggctttgaataaatcagggccgccgctcttttgtccctcaaaggaatgacgaccacaagctaaagatcacggcggctttaggagggagccgccgtgaagcgagaacagcttcgacataattcggcaggaatttacctgtcaaaaaaagcctgtccccggcagcggggacatatacccaagaagatgaactatactatgtaggtaagcagcaaaacacaccagatagcgtctggctggcgtatgaccagtcaggcgttttttgtcgcatcctgcggttttccgtggggtgtcgttctccaccgtccccatttcaattcacccgtcaacccctgaattgaaatggaggacaagtatgttcaataagaaaagtgaatacgcgcagaataagcgcgagaaagatagcatcatctacataagtgtgaatggacgcatccggctcacccgcgcagacttttccagtgaggaagaatttcttcgctggaaacaatggtccgatgaggactactatgagacggaacgccgggggcgtggatactacgataacggggttcctctggatgaaaacataagcgcggcaggtgcggtggagtctgcggaggatgcttatttccgtgagcttctggctgatgaaatcgaagcggctcggaaagctctgtgtcaggagcgcatggctaaggtgaaagcccttctgaccgccaggcagtaccgccggatctggatgtgtttggccgaagaaaaatccatcacagagatctccaggattgaaggacggtctaaagccagtgtgtcccgttctattgctgcggcgctccataagctccgcaaactgcgttaaggcagaataagaaactatcaacaggggtggcctgcagatgcaggccgccctcatcatggaaggaggctttttcatggcaaccacgcggctcatgcccctgcacaccggcaaaggccggacggtggggacggccatcagcgacatcatcgactatgttcaaaatccgcagaaaacagataacggcaggctcattaccagctatcaatgtgacagccggattgcagatgcggagttccttttcaataagcggcagtacatcgccgccaccggccgggtacggggtgaggacgatgtgattgcctatcatatccgacaatcctttgtccctggtgagatcacgccggaagaagcaaaccggctgggctgtgagctggcgcggcgcttcaccaaggggaaacacgcctttattgtctgcactcacattgatagaaaacacatccataatcacatcattttcgatgccaccgcgctggactaccagcgaaagtttcggaacttttggggcagcacccgcgcggtccggcggcttaatgataccatctgtatagagaacggatattccattgtagagaacccgaagccgcatggaaagagctataacaagtggctgggtgatcgggccaaacaatctcagcgggagacgctgcgtgtgatgatcgaccaggccctggagcataaacccgccgacttcgatgccctgctgaagctgctggaagggatgggctgcgaggtgtcccgccgtgggcagtcgtacagcatcaaagcacctggatgggacaatgccgcccgcatgagtaagaagctgggcaaagggtacagtgaagccgagcttcgtgcggttctggccggagaaaaggaacatacccccaccaggaccacgccccacccggagccgaaacaggctgtgagcctgatggtcgatattcaggaaaagcttcgcgctggcaagggggccggttatcagcgatgggccaccggcttcaatctgaagcagatggcgcagaccatgaattatctctccgagcataaactgcttgattataaagtgctgtcggaaaagacagcggcagccaccgccctgtacaatgaattgtccgcgcagatcaaggcagcggaaaagcgaatgacggagattgcggtcctccgcacccacatcatcaactacgccaaaacgcgggaggtctatgtcgcatatcgcaaggccggatattcaaagaagttccgcgccgagcatgaggcagacatccttttacaccagaccgcaaagaaagcatttgatgagctgggaatgaaaaagctccccaccgtcaagagcttgcaggcggaatatgcggagctgatggcacaaaaaaaggcagcctattccggctaccgaaaggcccgtgatgagatgaaggagcttctgaccgtcaaggccaatgtagaccgcatcatgggctatgaggaagaaaagcagacagaaaaagaacacgcccaggagcagagccagggacgatgactgactcatggatttgggcttttcgggagggaaagcctgcggcggctttccctcttgtctgctcaccggcgcaggacgggaaccgggtcaagagtgcgaagcatccgcccaccggcggcttgctcttgatgcggtttctgtcctgtgctatccatcgcctgggcgatggaaaaagcgttctaccagaacgcgcagccagctccaaaatggagctgtttatgggggtttgggggcagcgccctcaacaagcaacctgggatcttcgcgccagcgaaaatcccaggtttggcctcggtgggtcccacgaggcattgcttgccggtttctcgtaccccgtatttttgccctttcgggcggtatttcttcaaatgagaaaagaggacgcttacacatcctccttctcatcatccgcatcttttaatttgatggctccgtcaatgacgccttccacaatgggcagatacttctccgggcaaagctgtaatttgtggcttgtccgttggcgcagctcactgtcctcccgaagtaactccgggttgaagtagcgttctgcgggcagcttgcaaatgcggatgagctgcatcacaaccggcacgctgggtattgtgccgcacagctcaatatttgcaagatagcgcgggtcgataccgaccttttcagccagctcccggcgggacatttttacagcttcacgcgcctgctgaacatctgctccgaaggtttcaaatccagggcaatctttcacattcggcatatcacatcaccctattacattctattgttcataggatgcgctgggaatgatatgatatgcgctttagcttcattttataattccgccaatgtaaagaattttatgatgaaagtcagcggattacactgaggataccgatagagaaaactcaacctgttaatgcactgttagctttgactactcaaagttagaatgacctattgacaccggttactcgatatgatatattaagaccgatggattgaaactggtggtcttgaatgaagggaggcgaactatggcaaaaagagtggcgggagtgactgaaaagctcatggaatgtgctaaagaggagtttttagcaaatggatatgaaaatgcttctctccggataattgcagaaaaggctggatcgagtaaaggcgcaatctatattcgctaccctgataaagaaagcctatatcggtccctggttcaaccggcggcggacggtttttgtgaattgttacaaaccgtattatccgggtttaccacgatgccaggtaatgagcagacagagcaaatgcttcgatattccaatgatggctttcctaaagtagtggactatctttacgatcatttcgatgaatttaagctgttgcttaccagtggagagaatagtgtctatcaagagtttattcatcgtgttgttgagctggatacagaatgtactgcaaagtatattgaggcatctggaaatgatgcaataacaagcggccggctcacgccggaactaaatcatcttctttccagtgctttctatacgggaatgtttgaggttatcattcacgatatgccgaaagcccaggcattggagcatatccgcaaaatgcggcgtttctataccgctggatggcagaccatcttttctacggatggaggtgatgtcgtatgagtggttggattgaccgcaacggttggattcactgtcctacctgcggcaacaaaacccgcacgaaagtaaatccggatactgttctcaaacactttccgctattttgtcctaaatgcgggaaagaacacatcgtagatgtgcagggacaaagcatcatattatcagagccagacgccaagacgcagagccgataatttacaggataaatcctgtggattgtcggcttttacttttaacctatggttaggttctgctaactaaaaggagggaattgtatgcagcgacaaaaagattctgtaaatctgatgacattcattaaaccgcatcaatcaggctttttgctttctatcattcttgctgttatcagcgtcacaagtggtatcgtgccatatttcgctgtggcaaggatcgtaaatctgctgattggaggtgaaacgaatttttttgcttatttaacatggggaattgttgcccttatagcttatctgatgaagtccgtttttcatgggttatctaccagatgttcccatgaagcgacattccatgtgctttcagaaatacgacaggcgattgcggataaattaacgcgtgtttctatgggatatttgacggatacaccttcgggacggctgaaaacaacaatggtagagcgtgtagagcaaatggaagtccctctggcacatatcatcccggaaatgacttctaacctgcttgtccccatcgccatcattatttacctgtttgtgttggattggagaatggcactggtatccctgattacgatacccatcgggatgctctgttacatggcccagatgaaggaataccctaaaaaatacggtgctgttgttcaggcaagtaagtatatgagcgccaccactgtggagtacatcaatgggattgaggttatcaaggcgttcaatcaaagtgctgcctcctatggaaagtttacacaggctgtccgtcagagcgtggatctcatgctggactggatgaaatccacccagggctattctgctctgatgatgacgatttggcctgctgtactgattggtgtgttgcctgtgggatgcctgttctatatgaacggctctttgtctgctccggactttatcaccattgccattctttctcttggcattatggggccgctggttgccgctatctttctgacggatgatttttctaaaattgcaactatcaccggagaaattactgctgtattgtccgagcctgatctgaatcgtccgtcccagaggaaaaatctcaaaggattggatatttctctgcgggatgtgacttttgcttataaggatacgcaggttctgaacggtatcaatctggacatcagacaaggaaccacaacggcgttagtaggaccgtccggctctggtaaatccacgattgcgaaactcatcgcctcttattgggatgtaggaggcgggcatatcaccattggtggtgttgacgcaaaagaacttcctccagagcaggtaatggatctgattggttatgtatcccaggataattttctgttcaatttgtccgtccgtgagaatatccgcatgggcaggccagaggcaacggatgccgaagttgaggcggtggcaaaggctgcgggctgtcatgagtttatcatgggattggatcacggctatgacacgattgtgggaggtgctggcggacatctttccggcggcgaacggcaacgagtagctattgcacgcgccatgatgaaaaatgcacccattgttatcttggatgaggcaacttcttacacggacccggaaaacgaggcggtcattcaggatgccataggacggctgactcacggaaagacactcattgtgattgcccatcgcctgtccaccattaccggagcggaacaaattgctgtggtagatcacggtaagattttggatgccgggacgcatggagaactgttggagcggtgtccgctatatcagcaaatgtgggcagctcacacgcaggcgcgagacaacgatcagatggaaggaggtgcggcgtatgtttgacgcatataaacggttctttcgattttccgggacagagaaaggcacctggtataaaggcatggcctttgaactgctgcggagcatttttgaggcgttacaatttgtcgctctattggtagtgctgcgggcattggtagaacagaacatgaccggaaccaccgcatggacagctttgggaatcatggcgattagtgtggctggtgccgcgttctgctggtatctggcccacaatagcgagggacatgccaactaccgaatgtgcggagaaaagcgtattcacatcggtgaacgcatgaaatatatgccgatgggttatttcaacgcacagagccttggcagtcttactgcggcagccacctctacaatgtccgatttggagagtatgtcttttgcagtgatcgcccggacagttgtgggtatgatccggactacgattttttctctggcgaccatgtgcttcgactggagaatcggtctggtgttctttgttgggatactgctgttcctttgggtcaattcccgactacttaagaaatcccgtgagctttccccagggcgattgactgcacagactaaattggtggatgctgtgctggaatacatacagggcatgagtgtggtgcgcgctttccacggggataaagcggcaaaacaaactctaaacaataccatcaaagaaacagaaaatcaaaacttcaaattggagcgcaaacgcatcccctacaatgtgctggagcaggttgttttgcgtgttacttctgtattggcaatcctgctttccatctggcttttcctgcaagggaatatgtcgctgttcacctgcttgatgatggtggtatctgcgttcctggtatatagcgaattggaatcggctggtgagatgttctttatgctgccgatgattgatacttccattgaccgggtagaggaaattgaccgggcacccaggatggatgagggcggctctgttcaggtgccgaaaagccatgacatttcatttgagcatgtggacttctcctatggagatcggaaaatcattgatgatgtgagcttcacaattccagaagccacgactaccgctattgtgggaccctccggttccggcaaaacaacgcttaccagccttatggcccggttctgggatgtgaacaaaggctccgtgaaattgggcggtattgatgtaaaagactattcgctggacagcttgatgagcaatttcagtatggtctttcagaatgtgtatttgttcaacgacagtattgaaaataacatcaagtttggtaagccggcggccagtcatgaagaagtggtggctgcggcaaaagccgcccggtgccatgatttcattatggcgctgcctgacggctatgacacggtgattggtgaaggaggagccacaatatccggcggtgagcgtcagcggctttccatagccagagccatgctgaaggatgctcccatcgtaattttggacgaggcaaccgcaaatgttgatccggagaatgaggcggaacttcaagcggccattgaagcattaaccggaggcaagaccattattatgatcgcccatcgactgaaaacggtgcgccatgcaaaccagattttagtggtggatcacggaaggattgttcaacacggcacccacgaccaactcatccagcaaaagggcatttacgctgatttcattttgaatcgtaaagctgcgattgactggaaaatcaacgcatagtgcagggaggcggaggtgtgagtacaaaaagatttctactccaaaaaattttacaactttttttaaccttatttctggtaacggcgatcacttttatcctgatgcagctttcgcccatcgatgccgccgaagcctactcgcgccgtatattcacggtcgatgagacgcgtattgaagcagtgcgtgagcagatgggattgaatcgcccgattgtcgtccagtatctggactggctgaacgatttgcttcattttgacttgggaaattcatatgtggacaatcgggatgttttccttattgtcgggtcagccctaaaggaaactgcctgtattgtgctactatctgcggttcttcaagcggttggggcactgatattgggggttctgctctatctgacacgaaagaatgtgatcggcaaaatcctggcatttgcgtccatcgcggcaatatcaatcccagcgttttatttggcaacttcatttattgatgtggtagccgtgaggtggaacctgattagtgtatccggaaatacaggtttaatgagataccttccggcggcactctgtctggcggttggcgggattgcttttttcggacaaatgctttcaaaggcaattcagcaggccatgagcgaggacagtgttctctacgcccgttgcagggggttaagcgatccttatattgtagtgcgctacgctatgccccaggctatcatctctacggttccgacatttatgcagatgatgggaatgtgtatggcggggtccgccatagtggaaaacattttttctcttccaggattggggtatcggattgtaaacagcctgacaaatcgtgatctgcccgtgatttatgcaacggtgctgtttcttgcttttgcactggtgattttcaacattctggcagacattatccagcgcctgctccagacacgaaagggggacctgtaatgaaacatttgaaatggataattccggtcctcatcattattttttgttttctcggatttcttatcgcaccacatgacccggaggcgatggatattgttaacaagtatgcgccattcagtgcagagttccctttggggaccgaccagtttggtcgctgtgaattatcccgacttttgtatggcggttatgtgaccctcggtattgtgttgctgggcggaggcattgtgcttgttcttggtacgctgatcggattatggctgggcagagcaaatgccgccagaagtttggtgttcagtagcttgctggacgctgtgacagcgatcccacctttagcttaccttatcatttttgtcgggatatggggaaacagcatccctacgatgctggtggcgctgacggtctctctgattttgaggatgattaaactggtcaaaacacagacagagattgaactggataaggcttatgtattgtgcgcggtgtcctccggggcctcccgcagcagggtgttatttgtccatatcttgccgaacattatccgacccttggtacatttcctctgcctgtcctgcgcggaaatgattatgaatatctcggcgttttcctttatcgggctaaccttgggcgatgatgtgattgactggggttcgatgctctccgaggggcgcagtatgctgatgacccatccatcgttgcttttcctgccgatactatttattttcctgtgtaccttggcctttaatttgttggcaaaacagttggagggaggtgacgcggcatgatagaggtcaaaaacctgtctgttcaaacatcaaaaggagtcgttctgctggatcatgtggagtttaccttgacccctggtgtctgtactggattgaccggtgccagcggctccggcaaaaccaccctcttaaaggcgctgatgggggtatcagatggggatgtatccattaactctggacaaatattgctggatggagaggacctgctaaaaaagccagaaaaagtgcggcgggatctctgcgggacaactttgggatttattccgcaaaacccgatgactgctttcaatctccatgtgccagttgggacacagatgtcagagacatttcggaaacggcttcgattagacaaaaatgctgcccgcaaacttagtatggatgttttgcaaaaggtcaatcttctggatacgaatcgggtttatcgttcctatcccggccagctatccggaggtatgcttcagcgggcaactatggcgattttaattggcctttcccctcggtacatctttgcagatgagccgacctccgctttggatgaagaaaacaaggcgtatctgaaccaagagttgacgcaaatgaaacaaaaggcagcaattctgtttgtgtcccatgatgatgcagctattcgcactctctgtgatgagctgcttgtgatgcagagcggaatcattgtggagcgtggcacaacggcagatttgtttgccacccctcataaggagtggacaaaagagttcgtgcgtctggctatggttgaggaaggaggtggctggacatggaagaaatccaagtccgaaatgtgagcaaagactttctggacgcctctggcaagccctttcatgcgataagagacatttcatttacatgggtaaaaggggaaaatatcagttttaccggggaaagcggtagtggaaaaagcacaatggcccgcctcttaatcggtttggaacgccccaccagtggcgagattttgctggatggcgagaacattgccaaatggagttatggacagtggcgtagccatcgcacaaagatacaggccgttttccaggatgccactggcagcctgaaccgcaggctctccgtagggcataacttggaggaagcattgcgcaatttgaccaagttatcttccgaggagcgtaaaaagagaattttagaactgatggatctgacggccaccagcagaaaactattggatacgccaaccaaaaacctatccggtggtgagcagcggcgcgttgcactgctgcgggcgctggctgtgcggcctgactatcttattttggatgagttaaccagcggacttgatctgatctctcaaaaggcgattcgggaggttctggaggcataccatcgggaataccggtgcagttatttccttatcacccacgatatgaaattcgcctatcgcctgtcccagcgcatttatgagctggaaagcgggcaaatcgttaatatcggtcaatctaatattgacataaattcacaagaaaggaagtaaaccatgaaaaaatcaaaacttgctcgtctcattgcggccatttgttgtttcgccatgctccttgctgcttgcagcagtaatcagacacctgcggagtctggcggcgatggatcaactacggcagactctgaaaagaaagtgctgacctacgctattggagcagaaaccacagacctctccaccctctacatgaacaactccctgtgctgcacatccaagttggtgtatgagaatctggtggactttgacaacggagaaattgtccccggcttggccgaaagctgggaatacaatgatgaccagacagagctcaccttccatctgcggcagggagttaccttccacaatggagagccgttcaatgcggaggcggtcaagaccaacctggaacataagcaatctaacccgtccttttacagtttgaagggcattaccgatattcaagagattgagattgtcgatgaatacaccatcacgctccattacgaccatcctttctatgcctaccttcaggatttttgctggccagatgtaaaccccatgagcgcgccagagtacatcatccccggtgacttccagactatctccggcgtggcaggcaccggcccttatatctatgacgagtatgtggccggcgagtacactcgctttgttcggaacgaggactattggggagaaacaccctattgggatgagattatcgtcaaatacattcctgactcgacctcccgcctccaggctctccagaccggcgagattgacatgatctacgggggcacgcttctgacctatgaggaatacgaccaggctcttgctatggatggtatcgacgggcagatggccgaaaaagatacccgtgtgcaagtaatcacgaccaatgctaccagcccctatttgtctgatattcgtgtacggcaggccatagcctatgccattgataaagaggaaatgtccgtagctatttctaacggttatgaacctccggcagacatcccggccacccgtgatactccctatgcggatgtggagttggaaacaacttatgactatgatccggatatggcaaatcagcttctggatgaggctggatggttgatgaatgaaagcaccggtatccgtgaaaaagatggagaaccgttgagtctcttgctcacactggagactggcagcacatctgttagtatgcctactgccgaagtcatcaagagccagcttgcagaagtgggaatggatattacgatttacgggactgagcagatgcaatggtatgccgattatctggaaggcaagttcgatctgaccttgtggcattgccagtacgcctttgcatctccccattgctggtttacccctatggacagcatggtgccgcaaacgccctctctgcctggtattgaaggctctgacgagttccttgctaccatcaaagaattgaccaatatgtcggatgagcaggaagtccgggatacttatacctacctgtttaactacgatgtaggcaatgtgctggatattccgcttacttatcaaaaggatatgcttgtttataacactgacaagattgcaggctataccttcacaggtacaccttgcttctttgatattctgtctctggaacccgcagaataaaaaaagggggaataatacaatgaaactccatgcatcgggagaagattacctggaggctatcctcgttctccataagaagatgggcatggtgcgctccgtagatgtagcccggtacatggaggttacaaagcccagcgtgtgccatgcggtggctaccttgcgggatggaggctttctcataatggacgaagatcgctttctccatctgacagatgtgggccgtgaggtcgctgagaaaatctacgagcgccattgcttctttaccgagcagcttattgcggcgggtgttgaccccaagactgcggaggccgatgcctgccggattgaacacatcatcagtaatgagagctttgcgcggttgaaagaggcggccacgcaggaacagaattgaaccgaatacgccaaactatcctgccccgctaaacggggaaagaaaaaaaccgttgcggggcaggtggtttcgtgcgcgcaattcgcattttcacccaagcggcggttttgaaatacatttcaaggccgccgttcttcatgcccttatgagaatgacgaccctatgctgaatgttacggcggctttaggagggagccgccgtgaagcacagagagcttcgacataatccggcaggaatttacctgcctcaaaaatgcctgtccctggcagcggggacttatacccaagaagatgaactatacgatgtaagtcaatatcaaaatacaccagatagcgtctggctggattatatccagtcaggcgttttttgtcatatcctgcggttctccgttgggtgccgttctccaccgccccatttcaattcacccgtcaacccctgaattgaaatggaggacaagtatgtttgataagaaaagcgaatacgccctgaacaaatacgatcaggacagcattatatacataagtgtaagcggccgcatccggctcactcgcgcggacttttccagtgaggaagaatttctgaaatggaaaacctggtctgatgcagactaccacgagactgaaaagaaaggtcggagcttcaacgataatcgggtggctctggatgattacctggatgtggtcggagcggttcagtctgccgaggatgaatttttctctgagcttctgaaggcggatgtccaggcagaggaaaaggctttgcgtgagaaacggctggctgcattgaaagccattctgaacgcaaagcagtaccgccggatctggctgtactatgctgaaaggaagtctgtcaccgagattgccaggcttgaaggagtgacgaaggccagcgtctccctctcacttgccagggcaatcaaaaaaatttcaaaaaagttcgcggcgggcctcaaaaatagctaacaaacggccttaaaaaatgtgataggtgaaggacacattttcctcacccttcacagaaccatgacaactgaatatacggtattgcaggtacgaaactcgcgtgatgagcgacataaggtgcgccgccaggacgatagcttcaaggaggtgatgggacaagctatccgagcgatcaacgcataccttagacccggacaggcactccgggcgcgatgacagcgcgggggttaaagatactttctcacgacctcccacagacttgagggggaaccctgcggcacacgctttgagcgatgctgcggagttatgacagccctgccaagggcggcctgtaatatccccaccgctggggatgcgtggcaaatacagcgggcttgaagttactgaaaaatcaaggtagccgcgccgaagtgcgccgtatgttacaacggctccaaccagatcggcgcggctgcttttttgttctcgaaggaggcgaacaattatgacttcaaattcgcctgtttgttatgcgaatattccgtccgggagttccgggcgtactcatacagaaagatactccgctgttcagcctgcgggctttggtaagatcggcatgacgattgaagaagctgccgactataccggcattggacgcaacactctccgccgccttgtggattgggggaaaatcccggtcttgcggattgggcgtaagtccatagtccgtgtggatgtgatttgctgtttcatgcagatcaacgagggccgtgaccttctggaccgcaatcaggtccttgcggtggattgaacatagaaactttgaaatttagcaagcggtatgtttgataggaaagccaccctttgctataatcagggtgacacatcactacggttccgtttgccagcatagaaaggagtttgctatggcaaaaggatctgtaagaaagaaaggaaagaagtggtactatcgcttttatgtagaggatgccagcggcaaccgtgtccagaaggaatttccgggaacggaaagcaagagtgaaaccgagtctctgctccgcaaggcgatggaggactatgaaaccaaaatgtttctggcacaggccaagaacatcactttgggagatatgctggatatgtgggtggaggaagaactgaaacccggctcgttgagtgatgggacggtgacagcctacatcaacactgtttcccgcatcaagaagcaccccattggtaagcgcaagctcaagacggtaacttccgaccatctgcaaagctacatggatttgttgagcttcggagggacaagccccgatggaaaaaccgttgaggcgttgagcaaaggctcgctgggccagtattcggcagtgcttcaaaattccttccgctttgcggttttccccaaaaggctgattaccttcaatccgatgcagtatgtggtgaagcgggtcaaagacgatgaatatgagctgttcaccgaagatggcacaggcgaccttcccgttgaaacgccgacaatttcccatgagcagtatttggcgctgaatgagcttttgaagaaaaagcacaatcccgcgttactgcctatccagattgcctattacgccgggcttcgtatcggcgaggtgtgcgggctgacttggcaggacatcgacctgaaggaacagtgccttaccatccgccggagtatgcggtatgactccgtaaggaagaaaacgcagatcggccccaccaagcgcaaaaaaatccgtacagtggatttctgcgacaccctggcggccatcctgcgggaagccaaaaaggagcaaatgctgaacagcatcaaatacgggccgttgtactcccaaaactactatcgcatcatcaaggaaaagaaccgcacctactacgaggtctattccttgccccggacagagacaccgccggaagattacacccaggtttcctttgtttgcctgcggcccgatggagcttatgaagcccctgcaacggtcagcagcgtatgccgatactcccgaaagaagatcggggatatggatgattttcacttccatctgttgaggcatacatatacgaccaaccttctctcccacggggcggcacccaaggatgtgcaggagctgctgggacattctgatgtaagtaccacgatgaacatttacgcccacgccaccagagaggccaagcgaacttccgcaaggctgctggataaggttgtagggacggcctgaaaaaagtttccctcatttcttctcgcaagggaaaaaatgagggaaaagggccaaaccgaggtggcgaaaacgctggaaacaccagtgttttcaaggggtatagaaattttaactgagaaattagaatttctttacttactttgtcaagaatatctcttgtaggatgttttctttcttttaagaagttatgatcatatccaaaccctattaagaattctccttcttttattttattattctctttatattcatttaaaaaattaataatatcatcaaaattttttgcatttgataagtttgctataagaagagattttgctagtgctgtaatatgactgtgggcatctatgaaagaaggcattagacaattatcttcatagtcttttatttgtgtattttcatcctttaattttaaaatatcttcttttgttcctactttttttattattccgttttctgttagaattgcgttacaatgtatattatcttccattttaataatattgtttgataaaaatattgttttcatttttttatatcctttctctctgtaattttattatatcttattttttataattttataaaaaaaagagagaacattttgttctctctaaaatttaaggtatttactatgtacatatccataataagtttttttcccttttttaaaggtaattttataccatcttttgcctttgctgtcatttttatatccgtaggctgtaactttcttattatatgttattgttgttattctttttgaacttgttcctgcattgcttcttacatttaaaactaaagcttttacttttgctgtttttttagtcattgacaagtatgtttttagcacggcttttgcttttaacgaagaagaatatgaaccataatagtttttaccgcttaaagttctataagctcttactttataataataagttttattttttgaaacttttttatcttgatatgtatttccttttactgttgcaaggtatacataggtttttgatttagaattatatttatatattctgtatccgcttgctccatatacttttgaccatgtaagatttattttatttgtatatgttgtagttacttttaaaccactaacttttttaggatctgttgttgcataggttgcagaagatgcactgctgtatattctagaacctgatttgtctgtataaaaacttcttattttataaatatatgttgtagcactacttctttttgagtcagtataatttgtggtacttcccgatgttatgtcttttaatacatcatatttttttgttttagaattatatctataaatcctataacctgttgcattgcttattttattccaagttaattttattgcattatcactacttgaataaaaagttagttttggagtagatattgatggttcagatgattttggagtataccaaacatttatatctactctccctgaaataccatcaacacttccactgcttgtatgttgccaaaattcatatttaccgctatatgatgtagagcttgtataatgagcaagccatactttatatgtggaatctattgttgatttgtttaaatcataattaagcatgctgtaatttgcatataccataggagtgtatcctgcattttttactgttttgcaaaattccataacaatatttgttgctgcagttttagataaatttgcattggttaatctaccatcgcttccgccggcatattcatagtcgattacaacaggcatatctaaaccataaccttttatttgctttaatgtgtaattagcctcttgtcttgcttccgcagttgttattgcttgggagaagaagtatactcctacctttataccatattttttagcttctgtgatgtttcttttaaaagttgaatcgttgtcgattgttcccattttcccatatcctctgtatccaactctgataaatgcgtatttaataccatcgttttttactttttgccagttaattgttccattccaataagaaacatcaataccatacgttacattataatctttaaatttactgttatgagtatatgttttattatcatatggactttttaaattaaatccgctatttgtacttcttgccattggacctgttgaataaaattcatcagaaatatctccgtttgctctaaattgttgagggtcatcattagtaatatctttttcttctgttaagttattttgagaagatacagagtcattttgattttgtgttttttggctattttctgtttcttgattagattgtttttcagtttctttatttgtatctgaaccttcttttttttcatcttcttttgttgttgtttgaacttcttgatttattgtattgttttcgtcttcatttatttcttcttgatttgttgatgtattttgattttgtgtttgagccgaaataggtacaataaaaatattcattgcaaaaataattgctaaaataaaagttaaaaattttttcattatttccctttcctttagacatttttatttagtatatcataaaaaatataaaagtctatattttttttataaaccccttaaatattcctcttttaaagctatttctccatttattgcatcatctaaggtttttaatagattttctttatctttatttaaagtaccttttaagtttaaatagtttgaggcatgatttgaacgaaatactgcatttgaacagtttagattttcaattaataatctcgtttcttttaaaatatccttaggttccaataaattaaattcgccattttcaatttgttgttttaatactgtaccctcttcaaccataagagttaatagccctatatattcaggatccatttcagataaaacttctgcagttttaatggcatgttcttcccataattcacatcctccaagaccagatataacagtcacagatatttttagtcctgcatctttagcttgttttgctgcttttatcatttcttttgcagatgttctttttttaactttctttagtattgtgtcacttcctgattcaagtcctatatataaaagttttaatcctttttcttttaatactcttaaatctcttggctttttaaataaaatactttttgctgttgcataacatgatacttgcttgcattccggaaaagtttcttttatataatctagaacttcgtttaaagtttccatgtcgctaaatagtgcgtcgccgtcagctaaaaatattttttctacattatcatatgtccttcttgcttcgcttaaatctgcaagtatataatttaaatttcttattctgaattttttatctttatacatactgcaaaaagtacagctgttttgtgaacatcctattgttacttgaacaataaggctatatgcttcgcttggtggtctgtatacaattccttcgtatctcatattatctccttctttttaaaataagaagcttctttaagaagcttcttaatagtatatttcttcttttatttccttttctttttcttcgccttctaacgcttttagaatttcaaatccaaaatcaatacttgctgctgcagatcttcctgttataaagtttttatcttttacaacatacttatcaacatatgttccaccaaaatcttcattcattgatgtaaaacatgtgtaatttttgtcttttaagtatccagctctgcctaaaatagtaggaccagcacaaattgcacatattaatttatctttatcattaaattcttttattaatgcttgtacttctttacttgcttctattgtaacatattccggtccgccaggtaatattaaagcactgtaatcatcaccgtttagttttgagaaaggttttaaatttgtgcatgtaagaccgaatcttcctgttgcatctttatcaagtagtgaataaatatcaacttcaactccgcctcttcttaaaattgcatatgttccgattgcttcaacttcttcaaatccgtctgttattaccatacatactttcatatttatatatctcctttatcattattatcatattaataattatattatatcacttattcttgataataggggatagattttatgtatatgatatttatttaatatgtgtaaacgaataaaatatatttgttgatttatatatagatagtgtgtattatattatatatagaatatcgagtgtgtaaaatggagaggtaaacttatgaacagaaaggagttagtatatgatattttaagaaaatatcaatatgaacgagaaaatgtaaaaagtgtagaagatattggtcttgatgccagtgaaatatctgagctaattaatgctgatagaagtaatacaagtaggtatcttaacgaacttgtgaaagaagaaaaaattataaaattagatggaagacctgtaaagtttgttgaaaaagaaatatacaataattttataaacgaaaaaaataatgatatagacgatatggatccttttaaaaatctaattggttttaactcatctttaaaatctcatattgagcaggcaaagtcagcagtattatatccgccaagagggcttcatactttaattacaggtcccacaggtacaggaaaaagtacttttgcggaaaaaatatatgaatatgcaatggaaatgaagacaatagatagcgatgcaaaatttgttgtttttaactgcgctgaatatgcagaaaatcctcaacttgtaatgtctcagctttttggtcatattaaaggagcttttacgggagcagataaagaaaaaagcggacttattgatgaagcgaacggcggagttctttttttagatgaaattcatagactttctcccgagtgtcaagaattactgtttatgttaatggataagcatgtatttagaagacttggagaaacaggaggacaaagaaaagcagatgttcttattattggtgcaaccaccgaagatataaatgcttctttgcttcaaacttttttaagaagaatgcctgttacaattaatctcccttcgttaaaagaaaggcatttatctgaaagattgcagcttatagaaagcatattgtcaagtgagcagacaaatatggatgtttccataagagttcataaagatgctttgattgctcttttattatatgagtgtaagggtaatgtcggacagcttaaagctgatattcaacttttgtgtgcaagaggctttttggattataaagtgcacaataaaaaatacgtggaaatttgtacatctatacttcctgaacatatacaagaaggtcttttatattcaaagaataaaaatgatttgattgactttatcaaaaattcggaagaatatcattattttaataataaagaatttgcagtagaacaaaatagtgattctaatcttgttgctcatatcaatgataaatataacgattttatcaaaatgggaagaagcagcatggagataagcaatataataaattctgatttggacgaatatttcaatcaaatttttgaaaaatacaaaatagatgaaagagatattcacaaagaaagtttattaaaaattgttgatattaaagtattggaaacttgtgaagatgcaattcaatttgcggaaatgaagcttggaagaaagctttctgacagaataaaaataggaatgataatgcatattaattccatggttgcaagagtttcaaacggaacatacataaaaaatgataagataaatgaaattgtactaaataatccaaaggaactaaagattgccaaatttatttttgctttactggaagaggatttgagtataaaaattccaaaacatgaaattggatttttaactatgtttttatgtgcgccggaagaaatagaaaacaaaagtaatataggcgttattgtaatggctcacggaaactctacagcaagcagtatggctgattttgtaaataatttattaaatacgcaccattgcagagctttggatatgcctatggatatgagtacaagcactgcattaaataacctttgcgatatgataaatgataccgatgagggcagaggggtacttcttcttgtagatatgggttctcttaatatgatgggagaaatggccatgaaaaaaacaggaaagaatatttgtactgtagaaatggtgtctatcttacttgttatagaggctgtcagaaaggcaagcctaagagatacggatctaatttccttaaaaaatgatttagaaaatatttatcaaaatttacacagtaaaataagtgttttacctgcaccttatgaaaaacaaaaaacaattataacaacctgtatttccggaaaaggtgttgcagtaaaaattgataatataataaaagaatccattgatgtaaacaaatataatgtagtaataaaacatttggatatattaagtgcagacaatattgacaaggttttagaagaaaaaggaataagcgatgttatagctgttgttggaacagtggatttaaaaattaataatattccatttattccaataaatgaacttatagtaggaaacggaataagtattttgcatcagttgttaaatggacaaaagtatattcaaaatcaagaagatacaattattaataaaacagttgttaaagaaactttaaaaaatatacttacatttttaaattatgaaaaagcaagtgtacttttgattgacgcttttaatgatatcttttctaaattggcactttctgtggggaaagatgtatttttaagatttattatgcatacaggatgtatgcttgaaagagtcataaaaaatgaatctattccccatcttaatgcaggagaatttatagaagaacataaagaagagtataaaataataaaagaagctttctttaaatgcgaagaagattttaatatttttataccaaaggatgaaatttcttatataatagagcttttacattgatacacagtaaaattattttacagtaaaacttacacactgtaattaaaaaaaattttttaaaaatttttttaagtcaaatacctgttatttggcttatttttttataaattctaattacacacaaaagttggcacgctttttgcattatatatggcaaatgataaaagaaaaatgaaagggggtaaattcatgattgggatattagtagtaacacatggaaatgccggaatagaattagtaaaaagcagcgagttaattatcgggcatcaagaaaaaatagatgcgttatctttaaatcatggggatgatattaatgaacttgaacaaaaggtagcaaagaaatcagccgagcttgatgatggaagcggagttcttgtattggttgatttacttggcggaagtccgtgcaacgtaacaggtaagaatataaaaggttctgacaatatcgaatgcttgaccggtgtaaacttacctatgttaatagaagcgattgcttcaagagaaaataattccttaaaagatttggtaaatattgcaaaagattcatctcttcaaggaattaaagatttaagaaatcttatgtttaattaattttttatattgtcattattcgtaaaaataaaaggaggaggtaaaaatggcaaaaatcaatcttgttagaatcgacagcagacttattcacgggcaggtaataacaaaatggttaaaaatgtcaggtgcggacagaataatcatcgttgatgacgaacttgcaaaagatgactttatgtctattatctatacaactgcagctccaaaagacgttagcgtagaaatacttagtgtagaagatgctaaaaagggctggatggaaaatgaacttggaaacggaagtttattaattttatttaaagatattaaaacatgttatgaacttaaaaatgagggagtgaatattgaaaatatccaaattggaggacttccaagtgctccgggcagaactgttattttaagagcagtatcatttgatgaagatgatgtttcaaaattaaaagaacttcatgatgcaggagttgaaataaatatacatattattcctgaagaaccaaaaatgaactatgaaaatatgattaaaaaattcgaagaaaaaaaataagaaataattaaggagaaaaaattatgttattaacattagcgattgtagccggtctttggtactggattagtcaaagtaaattaggttatacattccactgggcgatttgtcagccgatcgttatggcactgccttttggtcttatatatggagatgttgcaaaagcaatgattataggggcatctctagaaatggtatatcttggtatggttgctgccggagcaaatattccagcagatgaaagtttagcaggagttattgctattccaatagctttagtttcagatattcctgctgcaacagcagttacacttgcaattccttttggtttacttggtgtattacaagatcaaatcagaagaacaattcaagcaagttttgctcataaagcagataaatatgcagaagaatgcaatattaaaggaatagaaagatgtgcgatattattccctttaattttaggatttttcttaagattcccacctgtatttttagctaattattttggagcgggtgttgttgaaaatattttagcggctataccggtttggttaactcatggtttagaagttacaggcggcgtattacctgcacttggttttgctattacagtatttattattggaaagaaaacatatttaccattctttattttaggattctttatggttcaatacttacaaattagtgtaatggcagctgcaatattcggaacatgtatggcattacttatcatattcttaagaagagaaaatcaaaatactacaacctaaaaggagattaaaatgaaacaagaaaatatggaaaaaaatttagttaacgaagaagttaatgaagttgttgaaaataaagaagaacaagcagaaaaaataacacaaaaagatattaataaagcattttttagatggtgggttgacgttgaagttgcaagctcatatgaaagaatgcaaggtattccattttgttattcaatgataccaattcttaaaaagttatataagaaaaaagaagatttaagttatgctttgaaaaatcacttaaacttctttaatactcaaggtacatggggaacacctattcacggtatggctattgccatggaagaagaacttcatgacggtgatagagaaatgagagaaaatgcaattacaggtattaaaaccggcttaatgggacctcttgcaggtattggagataccattgactggggcacattaaaaacaattattgcaggtattgcggttactttcggtataacaggtagtattcttggtgcgattattccatttgtattcacaatcattacattcttaattggtaaatatttatggaatatgggatacaaacttggaaaagaatcagttaagaatattcttcaatctggttggattaatgaacttatttcaggtacagctattttagggttattcatgatgggtgctttagcatcaagttacgttaaattgactattccaatagcctttacagttggcggcacggaaatgacaattcaaggtatcttggatagtattgctcctggattattacctcttggtgttgtatttggtatttattacattcttaaaaataaaacacaaaaatatggacttatttcaatcggtatagttgcaatatcaattttaggtgcaatgataggattattttaaatagatacatatataaataatagataaattagatgaatttttaggaggatttagacggatatgttagtcagaatggatgaaattttaaagaaagccaaagaaggaaagtatggggttgcggcgccaaatgtttataacgatattagtgtaaaagcttgttacgaggctgctgataaattaaactctccaattattttagattgtgccggacttcctttccttgaagaaactgcggatatcgtaagattttatgaaagaaaatacccacatgttgttgcagcattaaacttagatcatggcggtccttttgaagagattgttcatgcgattaaatatggtttcacatctgtaatgatagatagatcaactcttgaatttgatgaaaatgtaagagaagtaaaagaagttgtaaaaattgcccatggtgctgatgtttctgttgaagctgaacttgggcatgtaggacaaggctttgaatatgagcaaacaagagatgctggtcttacaaaaaaagaagatgctttaagatatattgacctaacaggtgttgattgtcttgctgttgcagttggaacatcacatggtacatataagggaactccacatttagagtttgaattattagatgatttaagtaaatcaattgatattcctcttgtattacatggtggttcaggtacaggagatgataacttacaaaaagcagtacaaacaggtattcaaaaagttaacttatttacagacttaagtacagcagcattaaatgcaatggttaaatatcttgactttgattgggacggtatgaaacaagacggttcaaaaggtgaatttggtaacttaaaagctaatttatgcgatatttcaattgccgcaaaagatggttttgttgaatctttagaacattacattaaactttttggttcaaacggaaaagcttaatttataaaaaattgattaaaataaactatataaggagatattatgaacaactttaattttttatgtgatactaagtttattttcggtaaagaaaccgaaaaaactgtaggtagtgaaataaaacaatatggtaaaaaagtcttatttgtaaatgacggcggggattatttaaaaacaaccggtttatacgattctgttgtaaattctttaaatgaagaaaatttagaatttatagaattaagcggtgttaaagcaaatcccgaagttgaacttgtaagagaaggtattgacatttgtaaaaaagaaaacattgattttattttggcagtgggtggcggaagtgttatagatactgcaaaatcaattggtataggtattttctatgatggtgatgtatgggatatttatgaaggagttggaacaataaacgatactttgccagtaggtgttgttcttacaattcctggaactggaagtgaatcaagtatatcttctattttaacaaacggtaattctaaaagagccattgatgatgtaagaatgagacctgtatttgcagttatgaatcctgaacttacatattctcttcctccattccaaacaacagcaggttgtgtagatattatatctcatgtttttgaaagatattttacaaacacaaaacatgttgaatttactgatagattatgtgaaagcacaattaaaacaattattgacaatgtatataaagttttaaaaaatccaaaagattatgaagcaagagcagaaataatgtgggctggaacaattgctcataacggaattttaggagtaggcagagacgaatgctggggggctcatatgataggtcatgaacttagcggtgaatataaaattactcacggaacaacacttgctcttattcttccttattggatgaaatatgtatataaacatgatgtaatgcgttttgtaagatatgcagtagaggtttggggaatcagacaaaactatgatgatcctgaagaaacagctcttgcaggtattgcaaaaacaaaagaattctttgaatcagttggacaacctacatgtttaaaagacgtaaacgtaggggatgaaaaaatcgttgaaatggcagaaaaatgcacaaagaacggtaatgtaggcggattcgtttcactaagcaaagaagatgtaataagtatttataaaagtgctttagaataaaattatatggtaaaaaggagaaataaaatggacataaaagaaatgaaattttcagttttaacagaaaaagggcatgcagaagttagaacaagacctttacctgaacttggagatagacaagttttaattaaacaagaagcttgtaatatatgtacaacagactatggtcaatggttaggacttagagaacatcaaggctatcctatggcaggcggtcatgaaggctctggtacaatcgtagcaaaaggcaaaaaagtaatggattttgaaatcggagacagagttgcaatggcttatgatggatgcggagaatgtgaatcttgtagaaaaggtgatgttttacattgcagtgatacttctataacaggaagaacagaagatggttatttaggtgcttttggttttgcaaattatgctgttagaaatgcaagaagcgttatcaaagtaagtaaagatttatctcctagcgaagctgctttccttgaaccattggcaactgttgtaaaaggacttaaaaaattaagagtaaaacctatggaaaatgtagtaatcataggtgcaggtacaatgggacttgttaatgcacaagctgcaaaagcaaacggatgtagagttattgtttcagaagtaatggaaaagaaacttgaaactgctaaagctatgggctttgaagttatcgatgcaggtaactgtgatccagtggaagaagtaaaaaaacttacaggcggtgtaggagccgatgcagttatcgttgctgtaggtttaacacttgcaaataatcaagctattgaaatgttaaaaccaacagacggaagagtattattctttgctgccggatatcctgctccacagcttgagtttgattcaaacttagttcattataagagacttgaactaatcggtacatttgcagcagattcaattgatttcttcacagctggaagaatgttaagtgatagaagcgtagatgtttcaaaaattattgagccaactaaatttaaacttgatgatgtgcaaaaagcctttgaaatggcttcaaaacctggtatgtatagagtaagcgtactacttcaagattaattataaaaatgttcgaataaaaataataaatactttaaaattaaaattgtcaaaggaactatgtaaaatagttccttttggtgctgttataaacttatgtaaataattggtgtgtttttataattaattttgtagcaataaattttaatatatgttatatatggtattaggaggaaaggcttatgataaagttagagcaatctcaaaaacaaaagcagcagctagtaatgacacatgaaatgaaacaggctatacaacttttacattttaatgtctttgaactcacttcttttatagaaaatgaggctgatttgaatatttttatagaatatgaaaatcccataaaaaaagatattacaggatctatggaaagggaagaatctataataactgaaagcgaggaagatgacgggaacttttatgttttcacttctaacagcggatttaacgaaagtattgtaaaggatttatcaggacagactttaaaagaaaatttattatttcaagtagggcttttagatataaataaagacgataagttttatttggaatatttaataaatgatgttgactcaaaaggatacttgaatatagatactaaagccgtaagttctgttttatctttaaaagaagaaagtattattagatatataaatattttacagtctttttctccttgtggggtctgtgctaaaagcccaattgagagaatcgaaatacaacttaaagaaaaaggaatttataaagaagaacattctatactattaaacagctatatggaaaatatagcttatggtaaaataaattcaatacatttaaaaacaggttttgacatagattatattaatgatttgatagaagatataaagtcttgtaacttgaatatagctagtgagtttattgaagatgaggataatttatacatatatcctgagcttagggtcgttgaaaagaacgggaaaattatagtatcattaattgaagataacactccttcaatacaaatggataaaagttctttaatagaaatgagtcgttttgtaaatgacaaagatttatcgagtttctataaagaacattatgataaggctttgtttataataagtgcagtaaaaaaacgaaaagataatatgcttaatgttaccgaagagatatttaaggttcaaggtggatttctaaaaaatggcaatttaaaacctctaaaaatgtctgatatagcaaatgcgtgtgatataaatgtttctaccgtaagcaggatagtaaatgaaaaatatgtagaaacaaaaagaggtgtattccctcttaagtcctttttcaaacagacagttggtggtagcagtgaattaaatgcgaatgaatgcactgatgatgaaataaaaaatcaaataaaaatcattatcgaaaaggaagataagaagaagccttttagtgatgaaaaaatatctaaaatgttaaaggaaaaagggtatgtaatttcaagaagaaccgttaataaatataggggacaaatgggtattcctccaacgacaataagaagaaaagattaaaagcagaagtaaaacttctgcttttttataaaaaagttttgattttttatggcgggggtagcaggactcgaacccgcgaataatagagccagaatctattgccttaccaacttggcgatacccctatatttataaaatatgatataccaacaaaatatatttatcaagtagaaaataaaaaacaaatataaaataaaaaaatcgaatgattgctcattcgattaattatctgcttggcaggggtagcaggactcgaacctacgatcacggagtcaaagtccgttgccttaccgacttggctatacccctgtgttctggggtgaaagatgggattcgaacccacggcctctggagccacaatccagcgctctaaccagctgagctacaatcaccatcaaacatcaaagtttatttttgtttttatggcgcgcctgaagggattcgaacccctgacacacggcttagaaggccgttgctctatcctgctgagctacaggcgcatattttaaattaatggagcgggtgaagggaatcgaaccctcgcgactggcttggaaggccagggctctaccactgagctacacccgcatctcacaaatgcttaaatagtataccccataattttaatcttgtcaacacgtttttaaaaaaatatttaatatttttaaatatttcttttttattaaattatacacgaatatgaaagagtgtttttgcctattataaaagggttttattcattaataaatatatgtgatgcaaatttaattttatttattataaattgtgatataataaaataaattagggatttaaggagattatttatggaaataaatacaaagcatttatttgaaaactataatatgtatgacggtaaagaagttattgtcgacggatgggttagaacaattcgttcttcaaatcaatttggttttatggaaataaacgatggaaccaattttaaaaacgtacaggttgttatagaaaaagataaaatcgaaaactatgatgaggtaacaaaattccatgcttgcagcggtgttaaggttgtgggaatattaaatgttactcctgatatgaaacaagattttgaaataaaagcaactagtgttactcttcttgcagatagtgataactcttatcctcttcaaaagaaaagacatacttttgaatatatgagagagattgctcatttaagaccaagaggaaacagctttaatgcagtatttaggcttcgttcattacttgcatatgcaatacatgaatttttccaaacaagagacttcgtttatgttaatactcctttaattactgcaagtgactgtgaaggtgccggtgaaatgttccaagttactacacttgatatgaaaaatccacctttaaatgatgaaaataatattgattatacaaaagacttcttttctgctgaaacatatttgacagtatcaggacaattgcaagcagaagcttatgctatggcatttaaaaatgtatatacttttggtcctacttttagagctgaaaattcaaatactcctcgtcatgctgcggaattttggatggtagaacctgaaattgcttttgctgatttaaatgatgatatgaatttggcagaagatatgatgaaatatgttataagttatgcacttgataaagcaaaaaatgaaattgaatttttcaataaatttatagataaaggacttattgaaagacttgaaggtatagttaattcaacatttaaaagaattacttatactgaagctattgaaattttgaaaaatgcaaaagaaaaatttgagtaccctgtagagtggggacttgatcttcaaacagaacatgaaagatatttgacagaaaagcattttaaagctcctgtttttgttacagattatccaaaagaaataaaagctttctatatgagaatgaatgatgataataaaacagttgctgctgtagacttattagttccgggcgttggtgaaattatcggaggaagtcaaagagaagaaaggcttgatattttggaaaacagaatggatgaacttggaatgaacaaggaaagtatgcagtggtatttagaccttagaaaatatggcggagtaaaacacgcaggctttggacttggttttgaaagacttgttatgtatctttcaggaatgaaaaacataagagacgttattcctttcccaagaacagtaaataatgcaaaattttaagataggggataaatatgtataaaattttagcgctggatatagatggaacattatttaatgataaaaaacaagtaacaccaaagaccgtagatgcgataaaaaaatgtaaagatttaggtgtgtatgttgttttatcaagcggaagatattataaaggtgtacttcctattgccgaaagtcttgaacttgataattgttatcatgttgcggataatggtataagttattttaatacaaagggagaagtaaactttataaaagtttttgataaagaagattacaaacgtcttgtagaacatttgagaaaaacatgtaaatcttttgtggttacaaatgaaatgggaatgtggtatgaaactgaagataaaagttgcgttactacaatgcgtccaaataatggtgatgctcattttatcaaattaaaagatattttagatgttccaaatccatttaaaatttgtgcatattatgaaaccgaagaagatgtaaatagaatattatcaaaggaatatgaaacaataacgggatgtgtttcttacagagtgttgatagatttttatcctaaaggaatagataaatttgttacattaatggaagttgccgataaattagatgtaaaagaagaagaaattatcgcagtgggagatagtgacaatgatcttcctttaattgaaaatgctgcgcttggtgtaagtgttgcaaacggcagtaaaaaactaaaagaagcaagtgatgttgttttggatcttgataataataacgatcccgtatgttatgttatagaaaatataatagagagaacgttgtatacgggaatgttttaaaaggagcgtaatgctccttttttattatacttaaattaaacttatataagtgtatattaattcctttatataaacagagctaagtttgaatgagtaattaaatattagattttaataatgttaatgcttgaaattacattattatgtataaaatttatggaaaagatattataaaatattttgaatttaaaagtttctatgttgtttgaaagatgaaagaatggtgttataatatctgttaaaatataagaacaaacgtggaggtagctatgtataaaggtggacttgttcttgaaggcggcggtatgagaggtgtctatactgcaggtgttttggatttttttattgataaagatatatattttgaaaatacttatggagtttctgcagggatttgtcatgcttgttcctatcttgcaaaacaaagagacagggcttacagggtaaatgttgattatcttgatgataagaggtatgcgagtttttatagtcttgttacaacaggggattattttggggtaaaaatggtatatgaagatattccaaacaaattatatccttttgataaaaaaacttttgaagaatataaaggaaatttatattctgttgttacaaatatgaagaccggggaggctgaatatataaaacttaaagatatggataaagatattatttatgtcagagcttccagttctcttcctttactttcaaggattgttaaggttgatgggaaagaatatcttgacggagggatagcagattctattcctattgagaaagcaataaaagatggaaatgaaaaaaacgttgttgtgcttactcagcctaatggatatagaaaagaaaaaaataagcttttgcctataatgaaaataaaatataaaaaatatccaaattttataaattcaatggcaaacagacatattaattataataattcattagataaaattaaggaagaagaggaaaagggaaatgtttttgttataagaccaagcgaaagtttggatataacaagacttgaaaaaaataaatataaacttgaggcattgtataatcttggttataatgatgcaaaaaaagcttatgaaaaattattaaactttatatctgattaaaaagaaccttatggttctttttttattaatttttcttaataactattaaaaaaatttaataacatcttaaactaggcttcaagattttattcttttaaaaatttataatgatattacagaattactatatactttgcaaagttttatattatttttagaaggtggaatttatgaaaaaagatgttttagttgtttttggaggagcttcatttgagtataaagtttctttagaaagtgcttactatgttattaagtcaatcaataaagataaatataatattcatttacttggaataaagaaaaatggaaattgttatttgtatgaaggtgatgtgaatctaataaaagatgatagatggtttgatgatgaaacttgttataaagtttttcttcctatggctaaggatgcaaatgggattaattatataaaagaagataaggtttattttaaacatatagacgttgtttttcccgttcttcacggaaagaacggagaagatggaacaatacaaggtcttttagagtttacaggtattccttttgttgggtgcggtgtgttgtcttcttcattatgtatggataaatatagagctcataagctagttgaagattttgggtgtaaagttccaagtagtatattgatagatgatattaaggatagagataaaattttaaattttattgatgatgtaggctttcctgtgtttgtaaaacctttaaaatcaggctcgtcttttggcattactaaagtaataagtgaagaaagattatataaagcattaaaggaagcttttcgttatgatgataaagttgtaattgaagaaaatattgatggatttgaagtaggggtagctattcttggtaataaaaaaattgttacaggtttgatagatgaaatagaaaccggaggaaagttctttgattataacgaaaaatacactctggaaaaatcactaattcacttgcctgcaagaataaataatgaacttgaaaaagaagttttagctttagcagaaaaaatatataaaattttagactgcaaagattttgcaagagttgatatgtttatagataaaaataacaacatatattttaatgaaataaataccattcccggatttacccttcatagcagatatccaaatatgttaaaaggtgtaggtataaattttgatgcaattgtaaatacacttattgaaatgggtggcggtaatgaaactatttattaataatgatatggtttatgacggtgaactggttttagtaaatagaaactaccctttaaaaaatgaacctttaaagtctggtatgaaaaatatagattttgaaaatggtatttatgtaaaaagtaaaatggcatttatgcttaaagagcttctttttgatattggtgttaaagatgaatttgtatatgtaagcggttttagaaccttgacagaacaagaaaatatttatgaaagttctataaaagaaaatggtgttaattttacaaataaatatgtagcttatcctatgtgtagtgaacatcaaacagggcttgctattgatataggtaaaagatgtgaagatgttgattttataagacctgattttccaagcagcggaatttttaaaatttttaaacaaagagccgttaaatatggttttatagaaaggtataaaaagaataaagaaaaaacaactggaatatcttatgaaccgtggcattttagatatgttggatatccgcattctttaattatggaaaaagaaaatttgtgtttggaagagtatatcgaatatgttaaatcttttaaacataaagaaaaaagtttgttttatagtgacattaataatttgatagaaatattttatgttccatttgcaaaggacggatatatagatatacccaataatatttcttatacgatatcaggtaacaatattgacggttttattgttactgtttggagaagttaaaatggaaaaaagaatagggtatggcggaattgatatttttaagttaattgctgcgtttatggttgttgcaatacatatctctccattatcttcttttaatgaaagtcttgatttttatattacatatgtattgtttcgtgttgcagtaccgttttttttaatggtatcagggtattttgttctttataaagtgttaacatattctaatggtgtaaatatattaatggcttttataaagagaattgttgttttatatttgcttgcaacattattatatattccaataaatttgtatgccggcagttttgaagatattaaaagtataggcggtattttaaaaatgtttttatttgacggaacattttatcatttatggtatatgccatctgtcattataggaagtatattgatatttattttaagtaaaaaatttaatttaaagcaggtttttgtaataacgttgattttatatgttatgggacttttgggagatagttactatggagttatatataatgtaaaatacataaagtgtttttatgattttcttttcaaatttttcgactatacaagaaacggtattttttatgcaccgatatttttaatgataggtattttatttagaagaaagaaaaaaagatgatgtaataatttctgattgtccttattttttattaaagcctgtatgtgaaaaaatgggaattaataatattatatctttagatgtaagaaaattttaaataaaaataactctttaggtaaaataaaagaatctatcattaaaaaaggaatacctttgtattccttttttacttttcaaaatctttaaacataaggcttggttgtattcccgtattattttgatatttaccgcttttatataattcgtattctcctttaatatcatggtagtatatttggcatatttcaacatttggatatattttaataggttggatacaaaatatttcaagagtccaataaccggaaaaaccaacatcaccaaatcctgccgtaacatgaataaaaagtcccaatcgtccggtagaagaacgtccttcaagcataggaacaaatttattggttttggtaaattcatttgttcttccaagataaagtttatttggttcaagtattaatccttcttttggtattattattttatgcgctttattttcttttttcatatcgagaacgtaattgtcatataccaaaagttcgtttgaaagagataaattatagctgtttggatttaatttatttttgtcaaaaggttctattattatatcttttccgatatttttttctatttcttttcccgataaaatcattgttttcctcccgataggatgtataatgtataataattatattttaaagtcagtatatcatataaatgttttttatcaatatgaataatttaataattaatgttttcattaaaataagatacataatttattaaaaattacttaaattttacatatttcatgatatattatgatacaatataatttacgaaaatctttttattagagaggaattgaagattatgggattacttggagcggttgcaaaatcgttggataataaagaaataaaaaaacttgaaaaaattgcagataaaatagatgctttgtctgatgaatacaaatctttgagtgatgaagaacttcaaaataaaacaaatgaatttaaagatagattaaaaaacggagaaactttggacgatttgttggttgaagcttttgccacagtcagagaagcttcggacagggttttgggacttagacattttaaagtacagttaattggtggtattattcttcatcaaggaaatattgcagaaatgaaaaccggtgaaggtaaaacgttaatggctactcttcccgcatacttaaatgctcttgaaggtaaaggtgtacatatagtaaccgtaaatgattaccttgcaaaaagagacagcgaatggaacggtaagatgtttaattatcttggaatgagtgtgggattgatagtacacggacttgactttgacgaaaaaaaagctgcatacaatgcagatataacttatggaacaaacaatgaattcgggtttgattatctgagagacaacatggttaaaagaatagatgatactgttcaaagagagcttaattatgctatagtggacgaagtcgacagtattcttatagatgaagccagaactcctcttattatttcaggaagcggaaatgaaagtacaagaagatattatgatgctaattcatttatcaaaacattaaaacctgaagattattcagttgatgaaaaagataaaacttgtaacttaactgaatcaggtatagcaaaagcagaaagagcttttaatatagaaaacctttctgatataaataatatggaattacaacatcaccttaaccaagcattaagagcaaacactttaatgtttaaagacagagactatgttgtaagagacggtgaagttttaattgtagatgaatttaccggaagaataatggaaggaagaagatattctgaaggtttacatcaagcaattgaagcaaaagaaggagttaaagttgaaagagaaagcgtaactttagctacaataacattccaaaactactttagaatgtttaataaacttgcaggtatgacaggtactgctaagacagaagaagaagaatttaaagaaatatacaatatgaatgtatatcctgttcctacaaataaacctcttataagggttgatatgaaagatgcaatctttactacaaagaagggtaaagataaagcaattataagagaaattaaaactagacacgaaaaaggacaacctgtgttggttggtacgatagcaatagaagacagtgaaagaataagtaaacttcttaaaaaagaaggaattaagcataacgtacttaatgccaagtatcacgaaaaagaagcggaaataatcgcagatgcaggacaaatgggtgctgtaacaatatctacaaacatggcaggtagaggtaccgatattgttttaggagaaggtgtaaaagaacttggcggacttcatatattaggtactgaaagacatgaaagtagaagaattgataatcagcttcgtggtagagcaggcagacaaggagaccccggttcttctcaattctttatttctcttgaagatgatttaatgagattatttggcggagaaagaatacaaaactttgcaagcagaacaagtcttgaagaagatgaagctttggaaagtaaaatgcttacaaagacaattgaaaatgctcaaaaacaaatcgaaggcaaaaacttcggtataagaaaatatgttcttcaatatgatgacgtaatgaacaaacaaagagaagttatttatgctcaaagaaagaaagtattaaagggcgaagatgtttcaagtgcaattcatgaaatgatagattatgttatagaaaatattgttgatgcttatacaacaaatgaaagctataatgataattgggattttgataaaatcaaggaaaatatatttacaactttcgatttaaatattgatattgatgaaagcataacagatactgatgaacttaaaaatattataagtgacggcgtttatgcattatataaatataaagaagaaaacgaattttcaactgaagaattaagagagcttgaaagacttgtattattaaaagtagttgattcaaattggatggaacatatagacaatatggatcaattaaaacaaggtatcaacttaagagcttacggacaaatcgaccctgttcaagcatatacaaaagaaggttttgcaatgtttgaagaaatgaacgaagtaattaaggaagatacggtaaaatatttattccatatgaaaaaagttgaagaaatagtaaacgaagctcctaaagaaatgtttacaaacagtcctgacaaacccgcaaagaaaaaacctgttgtaaataaaaacaaaataggaagaaatgatccttgtccatgtggttcgaaaaagaaatataaaaaatgctgtggaagaaacaaataaaaaagacactattaagtgtcttttttatttttcataataaatatcatcttcagttaaattttttatgacttctctgtatttttttaattctgtttttgcttcgttaagatcaagttctttgtaatttccgcattcaacagcacttttaccgggaacttctccttcgtactcacataaattatttactgtttcttttattatttcaataacttgtttatgtgttaaacccaaagttaagagataaaatcctgttctgcatcccataggtccaaaataaataatattattactgtaagaagagtttcttaagtatgttgcacaaagatgttctattgtatgaagtgctacatttgaaagaaaaggaggtgtatttggttttataaatcttaagtcgtatgtaataactcctttgtcttctcttgataaatatattcccggttcaagtacggtgtggtctaccataaaacttgctattttttccattttatttcctccgaaaaatttaatatataaatataataacatataatataaaaataaacacttataaagaaactttgtttttatatgtttggttaaagagtttgtgcatttaaattcttatatttatattttttatatatttttattaaaaacttaatataaacgtaaataaatctattatatattatataattaatttgaggtggtaatatgaatatatgtatttacggttcttattcaaaaaatttagataaagaaatgatagaagtttcaaaacaaataggaaaaactcttgcaaaaagaggacatgatttaattttcggcggtgggaaaaacggtcttttaggtggacttgcaaaggaagtaaatgataataatggcaagacaataggaataattttagacgattctgacatggaaacatttgtatataaagattgcactacattaatttcaaaggaaaatatgagtgttagaaaactttatatggaaagtaattgtgacggatttattattcttcccggaggaataggaactcttgatgaattttttgaagttcttgtacttaaaaataaaggaattataaataaaccaatcgctgtttttaactataataatttttttgacgatatgttttcatttatgaaaaaaatgtcaggtgaaaatatgatgaatgataaagtttttgatttattttttgtaactgataatatagatgatatgtttaattatttggaaaattattaataagagaggatatggatatgattgattatgctgaaggtagcggaaaacaataccatataggtgtaaaaaagggagaagtaggaaaatatgttcttcttccgggagatcctaaaagatgtaaggaaatagcaaagtattttgataatccaaaacttattgccgattcaagagaatttgttacttatacaggagagattgacggagtaaaagtttccgttacttcaacaggtataggtggtccttctgcggcaatagcaatggaagaattgaaagtatgtggagcggatacttttataagagttggaacatgtggaggaatggatcttgatgtaaaaggtggagatatggttattgcaagcggtgaaataagatttgaaggaacatcaaaggaatatgctccgattgagtatcctgccgttgctgattttgaaataattatggctcttaaaaatgcagcagacaagcttaaaataagaaatcatattggggttgttcaaagcaaagattctttttatggacaacatagacccgaaactcttccaaacaaagatgagcttttatcaaagtgggatgcttggtgtaagcttggttgcaaagcaagtgaaatggaaagtgccgctttatttatagttgcaagttatcttaaagtaagatgcggagcctgttttttggcaatagcaaatcaagaaagagaaaaagccggacttgataatgttcaggttcatgataccaatgaagttataaaagttgctattgaagcaataagagaacttataaaaaatgataataaataagcagtacattatgtactgcttttatttttgtaccgtaaaatatttatatccaaaaatactttctttgttacatatatttattttatcgtttatttttgtattttcataaatttcttcatttactgatacatcttgtgtttttccatttaatattactgtaaaataataactatcatcataagatgatgaactcatgtatttttctaatactgttacttgttcataagtaggttcgctaaatgtaagtatataatttagtggtgatactgtacaaaaagaaattacaactataaacagaaaaacagttatttttttccatattattgttttaatcttttttaatattgttgttattaaaaaaggtataagaataataatggagtaaattaatgtatgtataaacaatatattactattgtcatttatagtttcgctttgccacataaccataaaaatacatattagaactcctataaaaggaaaaggaattgtatacgattctgctttaatagaatctgctacacttgaagatttagaacaacctgaatatagaaaattttaaaagaagagtattttatactcttcttttttactccaaattcaatttcctttcaaagaaaaatttaacaataaagaaatatataatatttaaaattaacaagaaagcaattaatcctacaaataccaaatgagccatagctattggagataatgtattatttaaaaagttatacaatggacttacaaatattactcctaaaataattgttagaattgtagttaatacagatattgcaatgtaagacacaaacgataataaaattttatttttattaaaactgaaaccaacagccatagcagaataaacagccaagattttatttgagcatcctaaaataataataagcaataaataaaacattactaacaatacttttgctatatcacctccgtaaatcgtaaaggctcgttttatattaattacatcatttatatccaaacttgcaaaatcaaaaatacttgaaaacatgactaaacaaagtaccgaaataattattgctaatcccgttaaaattacccataaagtaccaacaatgactttgcttaaaatctcttttccaatattgattggaagagtatgagtaagataaccttcattagataaatctgccttataaaatctaattatacttaaaactgctgccaagattaatattgccataattcctaacatatatactgaaccgcttactgccgaaaagatattatatataatactatcatgaagtatattattagtagatattccaactaaaacaccattaagtacagatacacatattaaagcaattatagccggtatcataattcttttagttgctttaatttcgtactttattaatttacttaacatctgaattcctccctaaacaatttatcaatagacatacctttttcttctcttatttcatcagcatccccgtttaatacaatgctaccgttttttataaatattacttgatctaaaactttttcaatatcagaaattaaatgagtagatataatcacagttgaatcgtcagaataattatttattatggttttaagaatataatctctgcttgcaggatcaacaccccctataggttcatccaaaagatataattttgcctttctgctcattactaaaataagctgaactttttcttttgttcctttagacatattcttaagtttatcatttggagaaatatttaagctttctaacatttgatatgcctttttactatcaaaatcttcataaaaatcactaaagaaattgataagttcttttgcatccatccactcattcaaataacttttatcaggtaaatatgaaactatttttttgtttctattcccggagctaaaccgtcaatataaagttctccgccagatggaacaagaagtttattcaaaagtttaataagagttgttttaccgcttccgttaggtcctaacaatccaacgatttttccactttcaatgtttaaatttacattattaagagcaaactttccgtcaaattctttaaacaagttttttatttcaattaagttattcattttcttcccccttcattgattcttccataattaaagttatttctttttcatcaaatccaatttctttcatcttaattaaaaaatcatcaacatattcttcagccagcaatactctcctcctttgaataatctcttcgtcatccgttacaaatcttccgcttgttcttgaagaaaaaactatattatttttttcaagttcactaaaggccttttgcattgtatttggattaacatcagcaacagaggcaaattcacgaaccgaaggaagcttatcccctactttatattttccttttaatatatctctttcaataaatgaggctatttgtaaatatattggtctatcattttcaaattcccatcccatattaatcctgcctttcttttaatttgtattattgtattaatcaactaatacaataatacaatcataacttgcatttgtcaatataactttaaaattttaattattttttaatttaaaacaaatatataattttaaaagtttaaaaatgaatgtatttatgatagaataattagcaatggaaaagaggtttaaattatgagaaataaaaaaacattaatacttattctattattaacattttttataataccaacatttaattatataaatgcagatatagaaacagaaacggaaataactcaaaatcttgctaacacaattcaaggtaatcaaaatggctttacttatatgataaaagattcaaaagcttatattatttcttatactacaaaggaagaagaaataaaaaatcttacaatacctgaaaaaattaataactatcctgttatagaaatcagagataatgcatttaaaaatacttcaataatcaatcttacaattccaagcagcgtagaaactataggtgattatgctttctataattgtaataaattggaatctgtaacaataaacggatgcaaaaatataaatgaatatgcctttgcaaactgtataagtttaaaagatattactttagaagaaggaattgaaaatattgcagaaaatgcatttttaaattgtggtatgaaagaagtatctattcctgcatcagtaaaaaaaataggctctaatgcttttacaaattgtactaatttaaaaagctttacagtagcaaaagaaaataaaaaatttacggcagaaaatggtgtattatattcaaaaaacatgaaaactttaatatcttacccaataagcaaagaagatgaaggtttcacagtaaatgaaaaaacgacatcaataaaagaaagtgcattttattctaataaatatttaaaaaacatcacacttccaaataaacttaaatcaataggtaaatatgcattttacaacaccagaagcctaacaaacatagaaataccggaaaatgtagaagaaataaaagaagaaacatttttaggaagtgtaagtttaacaagtgtaacatttaaagatggggttataaccataggcagcaatgcttttagagaatgcgaaaatcttacaacggttaaattccctaacacactccaaaaattagaaggcggtgcatttaaaaattgttcaaaactaaataacatttctttccctgattctcttcatacaataggtaaagaagtattcagaggatgttcaagtttaacaaaagtaagtcttccaatttacgtaaactatttaagagattatgtatttgctgattgctctaatttacaagaagtaactttaaatgagggagtaacaaacattaatcaaaaagctttcagcaactgcccaaaacttaccaaaatagaagcaacatatagtctttcaacaatagattctacagcatttgatggaagtaaaaacataaaaatatatgcaccttatggttcttatgcattaacatttgcagaagaaaataaaataaataatgaatcaatatagaaaaagaagagataaaactcttctttttttgtaatgattttgtaatgaagtttgttaaaaataataattatgtttatttacttatctatgtaattatgttatagtattttataataaaacaagctggaattacaggagggaaaagagttgaagtatattgttgagcgagatttattcatgagtaaattgcaaaattatcttaatgaaaaagctgaagaaggttatacccttgttgatgtatttgtatctgaggaagatataaaagacggaagagaaaacaaataccaaagagccagtaaagttacagttataatgagcaaataaaaaagatgcaaaactgcatctttttattttttatattctagcttgaataatccaaaatattctttcttgctttaacaagctctatttgattttctaaaagtttattttgaagttcacttatagatcttctgttaagttctatctcacttctcattgaagtaaatttttccttgtactcttcaagcagatcttttaactcttcgttttctatttccattttttcatatttatattgcatagaaagtctttttgcttcattagcttctgcttcttcaagtgcagacattaacttttctttataatcagtcagaatttcatattcctctttatcttttctaagatcttcaacttcatcttttagttcgaaaagttcttcacataaatttaaagaagacaagactgcagcggtataaggattcatataaggattatttttcttaacttgtctgattaattcgtcaacaaaaccggcaactttttttaattgttcttcatcattatctgtaatgattgtataatttgaccctaaaatattaacgaccactctgttttttgctgtactcttttcttccatatgtatcacccattcttttataaaatataaaatatcaatatataaatatataataccacaaactttacattaaaaaaaagaaaaaattagaaaaatacataattttttcttttttttatactaatacgaaatattttacaaaatatgttatatttcttgtaaaatactgtctaagattgtaataccttcgtctatttcatcctttgaaataatcaatggaggcacaaatcttataatgttttgtcccgaatttaaaagtaaaagtcctttatcaatagccttattaataatgtcagaaacagggaattcaaattccattccaagcattaaaccaatacctcttacatcattaataaaatcatatttttcttttaactgttcaagtttagattttaaataaattccttgttcttttacgttatctaaaatattttcatttattatcttatttaaaacatatttacttgcagtagaagcaagtgcatttcctccaaaagttgaagcatggtttccaggttcaaaaccttttgccttttcttctttaacaagaattgcacctattgggaaacctcctcctaaaccttttgccatgcaaactacatcaggaacaacatcaaaatattcatatgcaaataaatatccgcttcttcctataccacattgaacttcatcaaatattaataatatatcaagttcatcacataaagctcttacctttttcaaaaattctttacttgcaggtcttataccgccttctccttgaacaggttctattataattccacaagcgccacatcttgcttctttttcaattgcttcgaaatccataaaaggaacatgaacaacatcaggtaaaataggaccaagacctttttgatatttaagttgtcctgtagctgttatagaaccgaaagttcttccatgaaaagaattattcatagcaataatttttgtttctttatttctaaatttatatgcatataatcttgataattttaaagctgcttcagttgcttcagctcctgaattacaaaagaaaactctgtctaaagcactattatcaaccaaagtttttgcagcctctacattcgctttagtataatataaatttgatacatgatataacttatgcatttgttcttctaatgctttatttaaaccttcatcattgtatcccaaatcatttacagcaatacctgccacaaaatctaaatatttttttccgttttcatcataaagatacacaccttctcctttttcaaaaactaaaggaaatcttgagtatgtatgcattaatactttttcacctgttttaactatatcttccattgctgcctactcctttatcatagttcctattccacagtttgtaaataattctattaataaactatgttcaactcttccgtcaatgatatgaacaccacttactccgttttcaacactttcttttgcgcctctaatctttggaatcattcccccattaattgtaccatcatcaattaaaccttgaatttcatctatattaatttgtttaattagatttttttctttgtccataactccttcaatatcagacatgaaaagaagtttttttgcatgaagagcgcttgcaacatggcaagcaacataatcagcattaatattatagctttgtcctgtttcgtcaacaccaataggtgcaataatagggataaaatcatcatccaaaagttttgcaataagcattggatttacacctttaatttttccaacaaaacctatatcatctccaccaggagtatgtttttcaacttctaaaagttttccgtcctgccctgtaataccaattgcattcattccctgttttgtaaatagagaaactaaatctttatttactccacctgcaagaaccatttgaacaatattcattgtatcgctgtctgtaaatctaagtccatttacaaatttatgttcttttcctactctatcaagcattttatttatatctttaccgccaccatgaacaattacaggtaaaataccaactaatttcattagagcaatatcatttattacactttgctccatttttttatctactaaagcagctccgccatatttaataactactatttgtccgttaaattcttttatataaggaagagcttctattaatacactggcttgtttaaaatatttatcatccattagcttctatactctccatttatttttacatattcataacttaaatcgcatccccatgctgttgcattttcttctccacagttcatgtttatatcaatttccacttcaacctgctgtaaaatttcaagagctttatcttcatcaaattcaagagctattccgtctttatataactcaatttcacccttaacacttttaaatgaaagtgtaactattgcaggatcaaaatcaactcctgaatatcctgccgcacataaaacccttccccagtttgcatcttcgccaaagaatgctgtcttaaccaaagaagaacctataatactctttgcaatcttctttgcatcatcttttgtttttgcatttaatacatttacggctaagaattttgtagcaccttctccgtcttttacaatttgagttgcaaggtgtttgcaaacaaacattaaggcatctttgaatacattataatctttatggtctttagtaagaacttcattacctgccataccgtttgcaaaagcaattacactgtcgtttgtagaggtatctccatcaacagaaatcatattataagtatcatctgcaatttcttttagtaaatctttaaaagttttgtcatcaatatttacatctgttgtaatgaatgaaagcattgtagccatattaggatgaatcattcctgaaccttttgcaataccgcctattcttacttttttatcatctattataatttcaactgatttatcttttataaaagtatcggttgtaagaataccttcagcacaatttacacctgaaacaatgtcatcgtcaagagcaagagaaacttcccttattccgtttattattttatccataggaagctgtacccctataacacctgttgaattaacataaacatcatcaggctttaaagcaagacatcttgctgtttctgctgccatttcatctgtgttttttaatccttgttcgcctgtgcatgcatttgcattaccgctatttactataatagctcttgcttttaaacctttttcatataaagccatattatgtaacacactgcttgcttttactttatttgttgtaaatactgctgcaacattacaaggtttttcagaataaataagtgacatatcctttctttttctttttagtcctgttgactttcctgatgcataaaaaccttttggtgcaacaacacaaccttttactatcttcatctatcaaaactccttaataactaaaataaaatatataaatcttttaaattaaaatatttttatatatataaaggaagaaaatcaatgccttccttttcgctaaacccaaacattatattcatattttgaactgcttgagatgaagcccctttcattaaattatctattgcacttgaaacgataattctgtttacccttttatcaagaacaaaagatgtatcaaaaatattagtgccttttacatagtttgttgaaggcaaattaccagactctctaagtcttataaaatattcatcattataatactcttcataaacttcttttattttttccttcgttatgctttcatccacatttgcataaatagttgtaagaattcctttattcattggaaccaaatgaggagtaaaagaaagtttaatatcatgtccatattttgaaagttgttgttcaatttcaggagtatgtctgtgtgtacctactccgtatgctttaatggattcattgcattcacagaataaagaaccaacatttgcttttcttcctgaaccacttacgcccgatttggcatctattattattgaattcacatcaataatattttcctttaccaatggatatagtgataaaatagaacaagttgtataacatcccggatttgctaaaagtcttgtattttttatactttctctttcaatttcacaaagaccgtatacgctttctttaagtaaatcctctgcaaaatgttctgtcttataccatttttcatatgtagccttatcttttaatctaaaatcagcaccaagatctattatctttgttttttccaaaacttctttcgtaacaacctttgatgcaactccatggggaagagccataaatacaacatcgcagtcatttgcaaattcattaatgtcgctttccaaacatggtccatcttctatatttctaaatgcttcataaacatcgctaaattctttacccacataactgtgagaacctagttttatatttctaacttctttatgtttttttaatatacttactaaaattgccccggtatatcccgtagcacccaaaatacctacatcaatcattccaatacctccataatatgatatattatacatattaatgtatatttatgcaagtattatttttagaaaattcactattgtatattttatttatattattttttaaatcattaaaatcagaactgttgtctattattatatccgcatacctcattttatcttctgtggacatttgagcttttatacgcattagggcttgttctttttttaccttatctcttaacattatcctttcaatttgaatatcttgtgaagtatatactagcattacaacatcaaccatattggtaagcttttcttctattaaaagaggacaatcgtatattacatatttttcatctctttgtttatatttgttcacaagataattatatttatctgttacttccggatggataatattatttaaagcaagccttgctttttcatcattaaaaacaagacttgccattttaggacgattaagttcaccattatctaaaatataatcactgccaaaaacatcttttattttatttaaccctctgcttcctttttgaacagcttctttacttattttatcagcatcaataattggtatattataatattcatttaaaatttttgaaacggaacttttacctgttccgattgaacctgttaaccctattactttcattatttcgcctcaaaccaatttttacctacatttatatcggcttttaatggacaatccatcttaactgcattttccattttatcttttaaaatttcttttacttccataacttcattttcaggtgcatctattattagttcatcgtgtacctgtaaaataagttttgatttaagatttcttttcttaatctcactttcaacatttatcattgcaagttttattatatcagctgcacttccttgaataggagtattaagagctgttctctctccaaaagatcttacattaaaattctttgaatgaatttcattaatatatctacgtctgttaaacattgtggttacatatccattttcttttgcaaattcaacaatatccttcatatatttgcttacatttggatatttagcaagatacgtatcaatatattctttcgcattttttcttgaaatgttcaaatcttttgatagaccaaagtcacttattccatatacaataccaaaattaaccgcttttgctctactacgcatttcgcttgtaacatcttctatattaacaccaaatacttcacttgcagttcttgcatgtatatcttcattatttttaaatgcattaattaacttttcatctgaagaaatatgtgccaaaactctaagctctatttgagaataatccgcatcaactaaaacattaccttctttactaggtataaatacttttcttattattcttccttcattcgttctaacaggaatattttgtaagtttggatttgaagaagatattcttcctgttgtagtaattgtttgattaaaagtagaatgaattttatcttctttcctatcaattaaagtaacaaatccttttacatatgttgaattaagtttacttacctgtcttaattcgattataagaggaattataggatgatgatcttttaatttttcaagtacttctatatttgttgaatatcctgtttttgttttctttattacaggaagattaagtttttcaaaaagaacatgtcctagttgttttgtagaattaacattaaagctttcatcttctcctgcaagttctcttatttgtttcgttaaattttcaactcgtttatcaaagtcttctcctaaaacttccagcatattcacatcaaccttaaagccttctatttccatatccgcaagaacatacataagtttatgttcaatattattatataattcttccattccctcttcttttattttttcatttagaagtttatataatgaatatatacattttgcctttttaatatatgttagatacttttctttatcctcaatatcaagaaaactttgttgaacagcttcacctttgtcttcttttaaatctacatcaagatattttttacccattacttcaagggagtatctttcatcacttggatttaaaacatatcctccaatataagtatcaaatgaacattcaacatcatatccttcacgtttaaaacatttatatacatttttaaagtcatgagtaattatattattatttttattcattattgctgccatatccgaaacaggtaaaacagttaaatcaaaaagatagaacttttccccgtcaaatatcatagcttcttttaatttattgttttcatcatttaaaacaaaataaatgctaatatagtcttttttctctaatactttgcaaagttcatcgggttttatgtcattacctatgtttaaatattcttcttttaaattagaaaaatcatcatttttttcttctttatctgcattattttctacaccaagtttcttcattattgatttcaaatcaagacttgatagtattgaaataaacttttcattattaaagttaaaatcgcattcttcttcaagatttatatcaacatccatatctacgacaatacttccaagttccttactcaaaaatgcattgtctttatcatttattaacttttcttttaattttccttttacttcatctatattttcatacacaccttcaagtgtcttatatttttcaagtaaacctaaagccgtcttttctcctacccctttaacacccgggatattatcagatttatcacccattaaagcttttaaatctatcatttgttttggtgtaagagaatatttatccataatataagcttcgtctattacttcaatatcacttattcctctttttgaataaagaatctttgtatgttcagaaaccaattgaaatgaatccctgtctccggttataacaacagtatcaatcccctttgagtctgctatctcacttacgctacctataatatcgtctgcttcataattatctacttttaaagagataatatttgcagcatctaaaagttcatcaatataaggaagctgttctcttaattcttcaggcatactttgtcttcctgctttatattcactgtatttttcatgtctgaaatttttatgtcctttatcaaaagcagcatataaataattaggtttttcctgttctataagctttaaaattatatttaaaaacccaaaaatagcattggttgaaacgccttttggagagtgcattggtcttactccgtagaaacatttataaataatcgaatatgcatctataataactaattttttcttcattttttcctcacaatcaaaaaaattctattattaaagaataacataaaaggtaaaaaaaataaatatattacctctttttcttattaagtaattctgctatactattttttacaaacaataaggagaatatgatgaatttaaaagaatatttaactgagggacttaataaatgtaatatacaaataactaacgaacaaacagagaaactacttttatttatggatatagttttaagagaaaataaaaaatttaatcttacggcaataaccgatgaaaaagaatttattgaaaaacacatcatcgacagcgccctttccataaaatatattaaaaatgaaggaaaacttatagatataggttctggagccggtatgcctggaattgtaataaaaatacttagagaagatttagatattcttcttcttgacagtttaaataaaagagtgaactacctaaataatacaataaaagaattaaaacttaataatatagaagcaatacatcaaagagcagaagaactttcacatgatgaagaatatagagaacaatttgattatgtaactgcaagagcggttgcttcattaaatgttcttttagaatatacaattccttttataaaaaaagaaggcagttttatagctttaaaaggcagtaaaggggaagaagaaatagaacaaagcaaaaatgcattgaatcttctttcttgtaaaatcataaaaaaccataaagaaaaactcccctattctctttcaaacagaaatatcatagagataaagaaaatggaattaactaataaaaaatatccaaggaaacaagctaaaataaaaaaaatccctctataaacagaagaaataaaaagcataaatataaataaatatgcataaaaataaaaaacatgttgatttttttttaaaatcatagtaaactttaataaagttataggtaaagaggaggattatttttattatgaaattgaaaaaaataattgcattatcaacagttgcaataatgagtcttgcaatgtttacgggatgtggaagtaaagaaacagcagataacggagaaatgaaacttgttaaagatggaactttaacagttggacttgaagctacatatccaccaatggaatatattgatgaagaaactggagaacttgcaggatttgatattgaacttgcaaaagcaatcgcagctgatatgggattagaagttgaatttgttcaagttggatttgatgcaatttttgccggtcttgatgcagataaatatgatgttgttatttctgcaataagtgttacagaagaaagacaagaaacattagaactttctgatacatatttagcaaatcaacaagtaataatttcagcaaaagacggaaatcaaattacatctgtagatcaattaacaggtaaaaaagttgccgttcaagttggaacaactgcagatgaagcttgtcaatattatcaaaatgacaaagcaatggaatttgacttacaacaatttgacgatatgacagctgcattccttgctttaaaaagcggaagtgttgactgcgtagttacagatttagttgttggagattattatgtaaataacaatccaaatgattatgtaaaatcttgtgataacttaacaaacgaacctatcgcaattgctgctaaaaaaggtaatacagctgttatcaatgctgtaaatgaatctttaaaatctttaattgacagcggaaaaactgctgaaatctcaaaagaattatttggtgaagatttaactaaaaacattgactcaaacttaaaaaattatgatgaacaataaataatttaattttataaaaataaaaaagcctgttttaggcttttttattttttattttgttaaaaagtataaatatgcatatttatttataaaaattaattaaacctattgcattttttctatatatatagtatatttataaagtatttttgttatttggaacggaggaaaaaaatgaaaaaagcaaaaaaaattactgctttgatcattacatcaatattaactatttgtttacttacaggatgtggttcaagtgaagaagtttcaacaactccacaatttgtaaaagaaggtactttggttgttggaatagacaatacttaccctccaatggaatatgttgatgataatggtaaaacagtaggatttgatattgaatttgcaaaagcaatcgctgaaaaaatgggaagaaaagttgagtttgtaaatgtagcttgggatggaatatttgcaggacttgattcagacaaatatgaccttgtaatttcttcagttggaattaacaaggatagacaagaacagcttgctctttcagatgcataccttgcaaatcaacaagttatcatctcttcaaaaaatggtgcacaaataaaatcaacggatgaattaaatggtaaaaaagttgctgttcaagtaagcacaacttcagatgatacatgtcaatattatttatctcaaggaaatgaatttgatttgcgtcaattcgatggaatgacagaagcattcgttgctcttgaaggcggaagcgttgattgtgttgttacagatttggttgttggtgaatattatgtacataacagtcctgataaatttataaaaacatgtgataaattaacaaatgaaccaattgctgttgccgcaaaaaaatcaaatcaaccattaatagacgaagtaaacaaaattatcgaagaatttaaaaatgacggaacgttagcaaatatatcaaaagatatattcggtaaagatttaacaagtaatatagatacaacaataaaaggttacgacgaataatatgtcagcataaaaagaaaacctatattgtataatataggttttcttcattttataaataaaaatttaggagatttaatatgactagtatacaaatcgaaaagctggttgaaggtacaatatcaacaatagagcttacaataataagtataattcttggaatgatacttgctttaatcttagcttttatgagcataggaaaaaataaaattttaaaaggtatagcatggttatatacatgggtattcagaggaacccctttgctacttcaaattatggttgtatactttgcaattccattaatgtttaaagaagtaacaggagaacctttaaactttgaaccttttacagctgctattatttcacttacattgaatactgcagcatataccgcagaaatattcagagcagggattcagtcaattgacaaggggcaacttgaagcagcaaaagctcttggaatgacctattcacaagctatgtttaaagttattattccacaaacatatgcaagagtcatcccaccttttgcaaatgaatttatcatgattttaaaagatacttcccttgtatctacaataggtatggctgatttaatgagagtatcaaaacaatttgctgcaagcggagattggagttactattttgtagccggcggtatatatttggtattaacatcagtatgtatcgtattcttcagacatcttgaaaagaaatcaagcaaatacctataggaggttataatgagtactttaaaagtagaaaatttaaaaaaagattttggaacattaagtgtattaaaagatattaaccttgaagttgaaaaaggtgaagtagtatgtataatagggccttcaggttcaggtaagagtacatttttaagatgtttaaaccaccttgaaaaaatgacttcaggaaaaatatatatagatgatgaattaatctttgacagaaaagataataaaagtttaataaaaacagacaaagataaacttgtgaaactacgtacaaaagttggtatggtttttcaaagatttaatcttttccctcataaaactgcccttgaaaatgtaacattagcaccaatggtagtaaaaaaagtagataaagatgctattaaagataaagctcttgaattacttgatatggtaggtcttaaagataaagcagacgaatatccaagcagactatcaggaggacaacaacaaagggttgccatagccagagctcttgcaatggaaccggaaattatgctttttgacgaagcaacatcagcattagaccctgaacttgttggagaagtattagaagtaatgaaaaatcttgcaaagaaacataatattacaatgatcgttgtaactcatgaaatgggatttgcaagagaagttgctgatagagttgtatttatggctgacggtgtaattgttgaacaaggtagcgcaaaagatattatcaataatcctcaacatgacagaacaaaaaaattcttaaagaaagtattataaaaagactgttaatacagtcttttttttatataagagccatatgaaagattttttcaagatctgaagcattcaaatcttcttttttatataaagttttagctattaaatttaaaacattactattttcgtttaataaacctatagccttttcatatgcattatctaatatattgcttatttcatgttctatatcttcttttaaaaaattatttttgtcccccgaaaaaattttatttttgtatttactcattccataatcacataccatagaataagcaagttcatttgcctttaaaatatcattttgcgctcctgtacttatttcaccaaatattatttcttcacttgctcttccggaaagtaaaatacatattttatcttccaactcattttttgtcaatatcattttatcctccccaaaagaagataacacaaatccaagagaaataccataaggaacaattgttactttatccggtaaaattccatttaacaaaaaacttataagcgtatgccctgcttcatgaaaagaaactattcttttttccttattgcttaagaccatacttttatttttaagtcctgcagttgtttttattattgccttatcaaaatcttcgttatttatagccttcttaccttttctaattgcgaggagtgcagattcgttaacgatattagcaagatgagcaccgcttaaaccatttgttttttcaacaacactgtcgattttaaaattctttgcaataggtttatttttaatatggtattttaaaatttctcttcttgtaatagcagaaggatttcctacaaaaatatgcctgtcaaaccttcccggtctaagcaaagccttatcaagcatatctattctgtttgttgctcccataacaacaacaccgctgttatcactaaatccatctaattcaatcaaaaactgatttaatgtttgatctctttcagagttattatcagtgttcctactaactcctattgcatcaagctcatctataaaaataattgcgggagctttttttcttgctttttcaaataaggctcttatcctgcttgcaccgattcctacaaatttttctataaattcacttcctgaagcataaataaatgttgccttacactgcccggctaaggcctttgctattaaggtttttcccgttccgggaggaccatacagtaaaacaccccttggaattttcgcaccaaagcttttatatttttgaggtttatccaaaaagtcgcttatttccaataattcttctttaatctcatcaagtccggcaaccgatgaaaaatctatatcagattttattacgcccgattcttctgatttattattaaaaaaattaatatacgaatgtctcattatctatctcccaatttgtttatgcaattgatattattgcttttaatttgaaaatttatacaaatactaaaaataaaaatattttttatttataaaatatgttataatgatggaaatacaggaggttacaaaatgaacaaagacgaattaattaacaaagccagtgaatttatcggagaagcaacagaaaaaacaaaacaaatttcatctgaagtaatagaagcatcaaaaaactttgcagaatctgctaaaaaaacaattaaagcagaaaaacttgattatcaaatttcaagaaaatacagagaaattggtaaattaatttatgcagcatatgaagaagaaggaacgtatgaccatgttgcagacgaattatgtgaagaaatcaatgcattatttgatcaaatcattgcaatcaaattaggtgaagatgctgatatttcagaagaagaaaaagaagatatcattcatgaaatcaacgttgatatcgaagaagaagacgaataaaaaagacgcataagcgtctttttttaatatagtgtttcattgttttttattaaatttggacatttattatcgccaccgttaagtttacatttaggtttacaatgataacaataatttataggaatattatttttagctttatatgcccactgataatcagataataactctcttcctatcgctgtaaagtcacaatattcttcttctaaaagtttttccgctctttcaggtgttgagattctattaacggctattacaggaatgtttacattttcttttattatttttgcacttgtaactacttcattaaattcatgttctttatcctctaaagatgaagatgcatcaaaggcagaagaaatatcaagaacgtctacccctgccatctcaagcattttagcacccttttttacatcttctatatcatccatattaactccaagtctgtaataaataggataatcctctcctacagcttctcttacggctcttacaacttctaaaggaaatctatatctatcttctatattatcaaacccatattcatcatttcgtttattatatttttttaaagtaaattcacaaagtaagtatccgtgagctccatgaatttcaacagctttaaaacctgctttttttgctcttaaagcagcatttttaaaatcatcaattgatttttcaatatcttcttttgtcatttctcttccaaaaccatcaattacactgggaccataaggacattcacttaactttgcttttagtcctgcattatgaagctgtataacactgaaagctccattagaatttaaggctgctgcaagtttagaaagatcatctataaacttatcatcccaaacacctatttgattccaagctttttgactcccatcaacgccgcttgcttcaacaatgattgtgcctacttctttctttgctcttttttcataataacttatatgtttttcatctataaaaccatcttccctaaccaaagaaaaagtaaccataggtggcataacaactctattttttattaggttaccttttagcaaataactatcaaacaacatactacacacctccaatttatatcattataccactatacatataatattttttaattattaaatcaaatgtagtaaatcaaaataaaaaaagccatttaaaatggcttttttctataagaaatctcttaattttttacttctggttgggtgtcttaattttctaagagcttttgcttcaatttgtcttattctttctcttgttacgcagaatatatcccctacttcttcaagagttcttggtcttccatcttctaaaccaaatcttaaaataagaacttttgcttctctatctgttaaagtttttaatacttcaaaaagttgagatctaagaagcatataacttgcagcttcttcaggagcaactgcatcatcatcaggaataaaatcacctaaatgagaatcttcttcttcacctataggtgtttctaaagataccggatcttgtgatatcttcataatatctctgactttttcttccggtagtcccatttctttagctatttctgcagcatttggatctcttcccaaatcttgaataagcattctttgaactctttttaatttatttatagtttcaaccatatgaacaggtattctaattgttcttgcttggtctgcaatagctcttgttatagcttgtctaatccaccatgtagcatatgtagaaaacttaaatccttttgtgtaatcaaatttttcaacagcttttaaaagccccaaattaccttcttgaattaaatcaaggaaagacatacctctgttaacatatctttttgcaatacttacaacaagtcttaaattggcttcacacaatttttttcttgcttcaacatcgccattttctattctttttgcaagttccatttcttcttcggcatgcaataaatcaactttaccgatttcttttagatacattctaacagggtcatttatatgtacagaaggctcatatccttttatatctgtcttttttatatctatatcatcatcttttaaatcatcatccaaaagctcatcaacatctttatcaatatcatcatcttgaagaacaattccttctttaaagaaaaattctaaaatttggtctatttcatcactgcttagatttaaatctgtaaaatgttgattcatttcactttgatttactacactttctttttttgcccattcttttatatcatcaatagattttaactttttaacctcttttctaactgcgtcttttttagatgtcttcttttttgaatttttacccactacttcaatagtaacattacttgtattttcttgactcattatattagagtacctccattttttgcttttaaaagatcagattttaatttataaaattcggctatcaaaacatctaacatttctttatcttcagaatcctgaatatctttaattgcatttttaacattcataatttttctgttaatattatttattatgagtgtttgtctcgcttttattacatcatcccaagttatattttgatctaaagacacgattcttgacatggttgtagccaatttatcattataatcaaacaactctataaagtcaaccttttttgcattatttatacaaaaaacaattttttcatatatttttttataatcatctcccacaaatacattttcatcaatattaatatcttttattttatcaatatctaaagcattttctaccatatatcttaaaataatttcttgtgcatttataatctttttcattatttggttttttttgtttgcagtttcatttttattttttccaattaaatgattaggtgttatataactatttgtatttacttcactttcaatagttgaaatttcggcccctgtcttgtgatgtaaatattttatatagaattcttttcttacattatcatcaactttacctataataacgcatgcttttttaataaaatcaaccttttcccaattatcaagtaagttatgatttttttctaataattttattctaaattcaatactgtcaattccattttccaccaaattattaaacttctctatgctattatttagaatataactatcaggatcatcaccctcagggagtcttacaaccttaggataaatatttgcactttcaagtatttcacaagctttaattgttgcatttaatcctgccgtatcagaatcgtacataacaacaacattttttgtatatctatttattaactttgcatgatttatattaaacgctgttccaagtgtggctacagaattgtttattccattatttacaagagaaataacatccatatacccctctaccaaaataagaggtttttgaggaagttcttttcttgcattatttaaattatataatgtggagttcttcttaaatacaatggtttcaggtgaatttaagtatttgggagcattttttacatctttatatattcttcccccaaaagctataagttttccatttacatcttgaataggaaacattattctatctctaaaataatcataaactcccccatcttctttagttcttacaagcccagcttttattagaacattaacagaatattttttttcttttaccaaataattatataacccgtcaaaactattcaaagaatatccaagtccaaatttttttatggtctctttactaagccctctatttaataaataatttaatgtaactttattatgaattaaatttttataaaaataatttgcagtatcttttatacaattgtaaagttcctgtttttgattatagcttatggaattttcactgcttcttgtataattgccgttttcttcatattgaacatttacaccttccaaatcggctaacatttcaactgcagaagagaaatccagcttattaatttccatcaagaaatccagtacatctccgtttgcaccacacccaaagcagtgatatctattcatatccggagtaactataaaagaaggagtcttttccgtatggaatggacaccttgccttatatctgtttccgcttctggtaagaggaacgtactgatttattatacctacaatatctgcatcatcaactaatcttctaataaaatcttttttaaaatatcctttcataaaactccttacattccccaataagcatttggaataaataactctttatacatattaattgcatatatatcagacatacaagctacataatcgcaaacaactctgtctaaattatcacaattaactcttacataaaattcttctaacattttatcaggatgcttcataaaatactcataaagtctttttactatggttttacctttatcgccctcttccatagctcttttagaatgatatacatttttaaataagaaacttctaagtcccatagttgcttcaaatatctcatcgctcatttttattttatttttatcatagctgttcttaataatatccaaaatcattgtgtttattcttttggagtttgtttctcccaaaatatcagtatattcttttggaatatctgaaggttttaagacaccaaaacggattgcatcatcaatatcatgattgatatatgcaattttatcggaaaagaaaactatttcaccttctaatgtactaggcttaaaaccatgacaatgattctttattccgtcaataacttcgtaagtaagattaagtcctttcccatctgattcaatttcttcaactactcttacactttgtaaattatgtttaaattcaaaggggcaaatctcatttaaaatctgttccccgctatgaccaaaaggagtatgtcccaaatcatgaccaagtgcaattgcttcagttaaatcttcatttaaacaaagagctcttgcaatacttcttgatatttgagatacctcaagagtatgagttagccttgttctgttatgatctgtttcaggtgaaataaacacctgagttttatgctttaaccttctaaaagattttgaatgaattattctgtctctatctctttcaaaatctgtccttatctcacatggtgttatttctttttttcttccttttgtatttacaactttaaaagcatatttatttaatctttttaattcttcttgttctttttgtttccttatattcattattactcctaatataacaaactactttatattatagcacatatgttttattttttagtattgataattattttaaataaccattatttaatattttattcttattttcgtttatatatgaaaaataatttttttctttttcactctttatattattcaaaagaaaaacagataaaaaaatcagcaaaacattcttacttccaagaagtaatacataaattccaagcattaaaatacccatatcgattattatacttatcagctttatatatttaaatgaatctagcttatttaattttaaattcaaaagcgtaaaaagacactttgaagcatccaaaggtattgtaggaattaaatttatagaacctataagaatattatagaaaataaaaaaatcataagaaggtatatacaaataataagatgaaaagacaattatacctgcaaaaataaaatttgacatcggaccggataaataaagacaaagtgctttatctgcacgtaaggcatcacaactatatgaaatttttgcaccaaaaggtaaaaattttatgttatttatcttaacatcaaatacctttgcacaaataagatgcgatgcctcatgaattaaaatagtaaacaaaaaaatcaaaaaatttacaaatccactttgagaataaataattaaaagagcaaataaactaagagaagttagtgtaaatttactcaaaaaaggcttaaacttatcaaacataatactcctttttcaaaaattatttttcgttttccttattatcatctatatccatataagaaataggatcaacagcagtattatcaacccacacttcaaaacctaatatgtcaccactttcttcactacccatagagcctatcaaatctccggtttttacattatcgcctacttttacaaaggtactttttacaccatcatatacgaccgtagtatcatttccaacatcaaatacaaccctgctgccaccgtaagaactagatacaatattagaaactactccccctatacttgcaaaaacctcctcgctcttacttgtttgaatttcaattccccttggctttactgttgtattaaaaacagggtgagttgtatcctcaaaagttgttataacttctccatttacaggcatttccaattttaaagtatttgatgagctattaacactgctcttttctccattaaaaacacttgccgtattatttacaaaagaaacaactttatctttcgtttcaccaaaagacaaaaattcactgttaaagacttctgaaatctttgaagttaaagaagacggtaattttacatcaaacatgtccattgaaacataagaaatagcaataataactaaaaatatcattatatttaaaaacctgtctttttttacttttgtattctttttgctgttatatcgactttgattataattataataattttttctttttttatttgtttttgaatttctgctatatttactatacataataacacctcttatatttatctcacttaagtatattaatcaaagtaaaaattattcataatatttaacttgaaaagaaaaaaagatttgtatataatgtataagaataatgcgagtgtgctggaataggcagacaggcacggttgagggccgtgtgtcccaaggacgtatgggttcaagtcccatcactcgcaccagttttttaaatttgtagaaatacaaaaaccacgtaaacacgcataaataaagggttttacagaataataatatttgtacaaatattaaaaatatgcggtcaaatataaaaaagtgcggtcaaaagtgcggtcaaatataaacaaaaaataaggggctttaagccccttttgttattatttaattttttcatctgttaaaagattctctctatacttatcagcctcaatagcttcttttgtaaaagagttgtttttccaaaatgcaagaacagccgaaacaattgtagttactccagttacaactgtgtaaattgtgttttcatcaatatttaactcagtaagtccaaatataccacaagctccatttatcaaacttacaaataaaaaaagcgtccttgtaatagtaccgcttgaaacattttttaaatcaatatttttcattctgttacctccctaaattatacatttatatgaacggcttcacccattccagcagtgccataataacaatatttagctccgtattcataagcttttgccttaattttagccttatcaactccggcaatataaatatctgctgctttaccatattggtgttgtgaattgctaacacatccgacttctgcattatgttttttacatctaagccctgatgtaattgttattggcttgccaaaatatgcccttaatttttctaaaatatcaataagctttgaactcatctctgcggggtaaccattacaatattttcctctgcactgacatttaaactctgattttttgaaatacttaaccttatcccaattcacttttgaagatgaagaacttgaagaagatgtattcttcaaagccttaatagtattacttcctgcaataccgtcctgagataaacctttcttcctttgaaatgacttaatagctgaaattgtagccgttccaattattccgtcaacactaagtttatttccttgtttattaagtaaagtttgtaaatttttaatgtcttttattaaggctgaatctgtcttacttccataaattccgtcttgtgtcaatcctttaaacttttgataactcttcacagctgattttgtcttgcttccgacttttccgtcaacacttccggtataaaatccataatagtattttaaattagattgataattttttatgcttaacactaatgtccctccttattttcaagttttattattcttaattcatgttcatcaagtatcttatcttgtttttcgttatattcccaaagtctttttctcttcattgcaagctcttctctgttttctttaaattcctctttcaattcttttaatacatcatttagatgattcagagaagattctatcttgcttacagctccagcaaactttgttatgttgataatcaccgttaaaatcaaaccaacaagtgcaatgattattgtaatttgtccctctgtcatctcataaaatcactccttcaaatttttattaaaatcactaaaaaaaggctttatgtaagcctttctaaggttttttatttttaaaccaaaaacctctctttttttgcttgtccaaaaaaagaggtaaaaaggacacttctcggcgaagtgccttacaacgcttttcgatacctgcgtaaaactctacacgagttttgctggcagaaaagctaccccaagcccaaatgaatgaaaatatggttaaatactaccctctccaataataatttagggcggtggtagcattccagctctaaaaatatgggtaatatttttagaaagcttcggaatgcgttataagccttcacggcgtttgagtgaaagcctttttcccatatttttgggctttggcaaaaatatggtggggttcttaaggggtaacaccccttaaataagggttgttaagggagaatcccttaaagtgttacttcttcccaacctgtcggatacgctgtcggtgtccatacgttattatctatctttgaacgatacacctttccgttttctgtacagcactcatctttcatgtacataccgcttgttccaagaggtgtaacataaggctttgcttttaatgggtcttttgtgtggcataagctccactgtgcccttaaattttcggggtggtctttgtaaactgtactgtcataaggttgtaataactgccatacttgtccgttatcttttactacctgcccctttgtccagtttaaatactgatgtaaattagggttaaaatctggaatatcatcttccctgtcgattatcgccgttccgtctaactctggggctttttcttgaaacaaggttgctgaatttaatcctacctctctcattttacttagtacatattctttagattccataactgtttaccccctcttttatagcatttgccagctcatcataagttacatagtcccctgttggttcaggttctggctcaggctcattttgttcatcctcccattcctttttcttttcttcatcaagtgtcaatattccgttttcgtatttgtaaacaaaacatggtaaatcattaaaatcttcaacacttaaatcagtttcaatactgttttcaacgtctccgacagttgcaaaagcaacaatatatttattttcatctaaacttattttcattattttaccccccatacatttctgatataatattcagtggctcctccaatagactgccccgctctgattataacgttatgaaacggattatcgattgtaattttgtttggctgtgacgggtcaaatatcattctccccgagtatagaactatggcatttgtattccattgagtatgggctacggcatcagtacataaaggagactgtcctccgtaatcactcaacaatgacgggtcaatggtcacgtatgagccatatccaaacggaatacccgtctgacctgaactaattaaaaagcaaagtgtcctgtaattttgaacattatcatttaaagttaaagaacctgttttaaccgctccgtcaaacagctttactcttttaacttgaatagcttccgtaaaagcagactcaacatttaaaagagtatccacactttcgatattaataccgtttaaattaacttgaaatacgggtagttccgcaaccaaatctccgttatcaatattaccttctgtataacttggaacagctggggtagttgttgaaggggtaccttgtattacctttaagcttacattttcaacctgtgtttcgctatttttttcataccttgcaacaattaaatctattctattttctcctgcggttccgttgtttattgttaggctgtcgtaggtgttcatatcaatagagcaaaacttgccctgcatgtttaatattccacttcttactcttatttcattgttacttataacctctgcttttaaattctctcccacagaaataatgcagtcatctttccaaatcccacggtgccacattgcatcctgcatggatgtcacatgatcttcttcttggtagcctgttattaattccatttaatcatctccttcaattttatattctatgctttcctgcccgttatccactgtatatatcttgtttactaccgggctttttaaactgtttcccgttatatagtctcttccgccgattatatccccaatttcaatatctatatttaaagtatttatatccatactaaaagtctttgtgttttttatttcattaagtttttcaattcctctttcctttaattcgtcgctttccgagtttgtatcttcataaacttctgctatctcttcaagacctttatagtatttattttcggttatttctccgttttcccctacatataaatctattaccaccctgtcagtaagttctcccttacctaaacatacaaggtggtttactccgttgttattttctttaaatataaagtccagcaaattatcctgtgaaagttcaaaagtgccagaataatctataatgggagtagaagaaagaagagcataccccctttctcccttttgcccttgaatgtatttaatgcttaatttataatttacactttttagcatcttttcaattcccttaagtaaagtacagtatcggtcaaacttaaaattacttatgtttattcccgtatcaacttcagagacactaaaaaaagagcctatgccctcttcatcaataagtgattttattatggaattaatctccccgcttacctgtttatatgcttgattttttggtggaactataatttttttatttaatattcccctaagacaataaccctttattataacggtgttatcacttgtatttgtttcaatacctccgattattcccgcatattcactgtttggaataaaaataatattaccgtacctaatactttcatcataatctatgggagaaatagtaatagtaaaatccatcgtatccccaaggtcaaaatcaaattttgaatacttaagatattttatttcccttccattactgtctgctattattaccacttcggctcgctccttttttcatataattttagagtaaacttaaaatctcccctccagttaaaagtaagtcttccgggaggtattttgttaaatacactgttttcttttccccttaaatcaaagatattaagtgttgttccgttgtttctgtattttattacgcttttttcttcatttacgctttttattattaaatattcataattttcaagggtatcaaatacttcataaggataattatttattagtattctcggattgacacaaggcccgtatataataagctcgaaatcactatatgaaaagttatctgtctgccaataacttatacctctttttacaggagtgtaattgtatggataattataaggatagtttagtccattaacacttgaagttcctccccctgtaaaatctctttgctgttcttttatccagtatggatttgcacttaccaccttaaagtcattaaacataaaaggtagccccatgttccagtcggactttaccgattcatatattctgcagggcagataatatcccgtatcagtgtataacttaccgtcactgtcatttataatgtcatactcaaacacttcaaatatatggttaaagtattcttttattttttcttctctttcttcttttgtcatatcaaagggaggaataacggcaatttttatgcttttttgcgttataccttttttaaaagaagttatcttatttgaatcggtattttcctgtgtttcataactccaggaataatcaagcaggtccccctcctgaaaaacataaggataatcggtaaaatctatcttttcattattggaatttacataataaaaattcatcctatcccctcctaaatccaagattagaaaccattcttgccacttctctgttatctgtcaccattcttatgttgccaacccctctttcaagagagtttgcaatctgacttccttgatttgatactgcacttactatatattcccctaaagcataaacatcaaaagaagaagtattgttattaagccttgcggattctttggcatatttaacgcttaagtcgtgagggattacctgtgaaccgtttggaagataagtaagctctcctcttcctgcttcattcatataagcaaaaccgccttgccagttatcagttcctctctttaaataagggatagtacttatgcttattcctacaatacttcctatatcattaataactcctatggcagtatttacctttcctataacagagtttataactccttttatttttccaacaactctggatactgctcctgaaattgaattaaacaccccgcttacaactcctgttaaccctttccatgaagtttttattttattaaacacatttgtaataattgtttttactttattaaacgtgcttgtaacaggagatataacttttttaattacgcttataataagattaatagctccgcctattaccgtttttataccgttccatactgttgtaataatgcttttaaccgtattaaatatagtgcttacagccgatataacagatgaaacaaccgttattatgtttgttataaccgttgcaataaaggaaattataggcgttacaacacttattattccccctataaccgatgtagcaatcgttaaaatttttaaaataataggaataacagttgaacctataatacttattattgtttgaataataggcataagtgcacttgtcacagtcatagcgacttttgctatggcacttataatcgtttgaattttaggaacaatggtatttaaaaattttatgataacaggtgccgcacttgtaataaaccctccaatcatgctaattatatttgatataacaggggcaagtttttgaagagtcgagcctatgacagaaccaacagtatttgcaatatttgaaagtatcggcattaaagcagataaaacagactgaacggaagtcataacggaatttataacactcataacactatttctaaaactttcgtttgttttcattaaatatgtaataacaccgataattgcagttattgctgcaatagctattgccacaggtcccgttatggcggtgaatactcccgcaagtgccgccttaagaccacccacggcagctatttttgcacttaaagctccaaatgcaccagtagcagaaccaataaaagaaaatactttccctaatattgatagaataggaccaatagatactataaaaacagtcccaaaagctgcagtttttcctacaacagcctgcattacaggagttaaagagttaaaccatgttattataccctttactttatttactacatttgaaaagctttctccaaattttacaccaagttcacttgccttaacttccaatgtagaaagataagaagtaaactcactcattagtggttttaactgagagaaaaaacctccgcctttgccgcctgcatctaaaaagtttgcacctattctggaaagagatgctcctatatttgcaagagaagcagaaaaagaagcctctcccattatctttgctgctccgcctatatttttttcaatagcagaatataacatttcagaagatattccaccttcgctcgcaagctgttttacttctgacgcagcaattcctgcctcatctgcaagccattgatatacaggcagtcctctgtctgcaagctgttctaaatcttcagtataaactgtctgtcctgtctgtactttgtttaaaatagaacccatttcagacatagaaacacctgcaatagcagccgcatctgcagtcatacttaaatatttggtaagttctttacctggttttatacctgctgccacagcatttgccgcagtagttgcagcttcatcaagtccaaatgcagttccttttaccgatatggtagcagagttcataatctcttcaactgttttagcatcatgacctaacccttttaactttgccttagcattatcaatgccgacaagcctgtcaaatccttttacaagggtaataccggataaagcacttgttgctatcattgccggtttagtaatagagtttgtaagcttatctcctactttttcaagtccggaacctacacttgaaaacttctttgatatataatctaattttgcagaaactttattaagatcttccacttgctgatttgaagattgttttgaagaatatccaatatcagcataagctttcttcattgcttctgatttagtcatacccgctttttgatattctgctgcagatttcattacatcacttcttaactcattaactgtctttccactttcttcagcaatttgagataagctttttccaaattgttgatttacattttttaaagatgatggaattttcttttcaaatgcttcagaagatgcttgaacttttgatattgctttttggaaattactactatctgccgtaatttttgcactaagtgtataatcagccatattatcctcctttctttttcattcttttatcaaaaccgttagccttatatatcttgtaaacccagctttttccttctcttttttccatatcttctataatttttatattgttttgatattcttctttttttacttttttaggtttcttcttccaaagttttaacggacttttcccttttggtctgtttacattgtaaaaagcagtaagcacagccttatataataggaagttatcggtaatgactttgttttcccattctttttttataaaggcgatttctttatatgtaaggctttcgtattcttcctttgaataacctaaattgacagcaaaaaaagcaaagtctatatctctttgataaggctttgcttctttttcatactctttatcttctccatcatttaaaagatattcaaaatcgactaatcggcttggaagaaaaaaggacagtctctttgaattgcttcaattactgttgtagtaatattggcatatcccttttcctctaaaagttcatcggcaatttttatgccttcgttaaaatcaacatatccgtctttacccttttctttaagtccaaaagcgataaagttacaaagttttgaaatactgagcattccctttgaattaaccattgtttccattaaagaaattccaagagtatcctctattattcttattcttccaacagtgtatttaagttcgtaaatttttccgtttatctctaacatataattattcccctgccgttacggtggcagttccaacctttcttgctttattattttcacattctacaattaatatcttatttccatttactgctgtaatctcatcttccccgttccagtcagtaagcgttgatacgtcatcatcatactttggtaaagtaacgctttcgcctgtttgatatttataagcattgcttccctcttttataggattaacgtatatttttgttttaccgcttgttcccgcaacggatacaacagttaaaccttcaagagaattttcaccgcttggcatggtatcgggaacaggtggattttcgcttaaatcaaccaaagctcccataccatccagtgaagtagaataggtcattgaatcatcgtatggggcttccagtgaataatccgtaagggttgcaagcccgccgaataaacctttttgtgtttttaaattaacaattttaatacaaaggggtgtatcgtcttcaaaagcttttgataagattttatgactttcatcatcggcaatataaatcccgtcattatcaatactccattctttcattcctgcaatctttgacttccagcctcccactgtatcctttgaagttatttctatgctgtcttttgtcctgtttattgttaaactttgttgtccgcttattgccagtaactttgaaccgtccaaattaaaaattgcaagtaaaatgtctttacctgcaatcgctcttgatgctgcagcggagaaatcacaatattctccaccgtcaaactctaaagcatatttttgtaaatttatttttttcatactacctcctattatttacacttaaaaccgtatgaaattttaaaatcatactgaaatattgcgtgtttttcttttgtttcttctgttattaagttattcattgaaatttgtgtctgcataataaggttaaacccttcaggtaagactatatcctccgtcattgcctcttcaagcttgtttattaaatcaaatataccaacacttgaagatgaagccttactaagtgcatgaatcatcacattataagtttcacaaaacatagtctttgtgtcgctttttctttttcctgttatttcaacataataaaagggactcggtgcatttatggggaccatatcgtaacaccttatccctgtattttcttctattctcttttgaatagcagatattaaatccgtatagtttaattgttttaacattttattttcctaaaccttttatcaaatcctttttataaatatccctttgaatatctacgttcttttttaagaaatactgaccttgtacatatccaacctgtttgccgtgtattactaccctgtgtccgtattcaacatgtgcttgtgttatcataaaggctttttatcctttatttccgggagtttcctcgcattacagaatgtcaattcattctcggttcggcgtacatcataacaaaaaaagaatctgtataagattcttccattgtttcgggcactcttgccgaaattatatttattcattcggtacgctctacggtgatcaatagcctttcgcaatctactgatttaccacggtgttgacatgcttataaatcttctctctttatacatttttttctatatagattataagctgttttatatggaatatttaatatttctgcaaattcaactaaagtaatccatttattattatattctataagaatattacttcttctgttacgacaattttcctttgcactaacccacctgcaattttcaggagaataatctaaattattgtctattctatcaatttgcaattcttttttaaatccgtttaaaacagcccattgaacgaaattatcaaaactttgaagccactcattacatatttttatccccctgcctccataatcattatatcttttatcattttgattataacatcttgacttcatactataatatgtatcccaaagttttgtatgacttaatttatgtttatgatttttaacaagattaattttatcttgttcttttttcaaacatccacaagactgcaccatcccctgcgtcagacagtccgttcttacttcttttaaattgccacattcacatctacattgccaataatagcgatatcgattaccttttttttcttttctcgctaatttaaccactgtcaattttgtaaatttacatcctgttaaatctttaaattttgccataatatcaccttttttttattatagcatacataaatttacatgtccatattctacatgtgtttatcactttataagtttagtgtccaccgtttttgcccgattttacatgcgtcacatttactgaagcgcataatcctttgtatatcctatttcttccttaccttttgatatagactgttttaattgactgctttttacgggagtaaggctttttgccctgttaaacatctgggtaagattctttgttacaattccttcaaacctaacttcatttaaccttttaagctctctttcaagctcttctattccttcaaatttaatatgtatcatctttcaacctttttaaatgaagaatattaaagcgaggggaagaatttatgatatacaagatttcatgttccttattttcaaatcttattaaattatctaaatttatgtttatgcttggaattattaaggcttttaaagtctttttagtgtaatcatatccataggtattagtctcttccaatgtccagtttgataatcttccttttgttttaccttttatattaagttcataggtaggatttaaaagcttatcttccccattttttactttctccaagacttctatttcttcccatttcataaaaatcttacaacctttctcgttccgtcttcgttgttattcttcttttgattcaaataactttctatctctgagttatattcgtttaatatatcttcaacaaaagaagtggaaatatttcccccgctttcagaacttattccctcatagtaaatacggttatacattttaaccactgcatcaacgcagacagaataaaaaatatcaggcagaatatcctcttttaatcttaaacaaagcctgtcgtaaacagtcttaacatattcacttattacttcatcactaagggaaacattattaatccttagctttactctatttaaaatatcgtccataactatctattattcacttgcttcacttgcttcacttacaggagtaatagttgccttaaatactccgtcaacaaattcagggtagaacttaacacttgaaagtaacagagtatcaactgacgcattttttaatacgttttgatgtgtcataccaacaagccccgtttcgtctgatgttaaattgaaagtctgtccaagatctcccgacattggaacatacgcaccgtttaagttttgttttgctgttgcgataggttttaatttttctgctttaggtgtaatcatggcagtaccaagtcctaagaagttctcaatataagtaaagccgaatgcgttttgcatagtaatttgagaagtccccaaataatctgaaacatctgtcgggtttacaaaataaatagggtcaatatccatatcttcatagtattcttgaagttttgcccataaagctgcaagggctgtttgtaaatttgtaccgcttgcacttccgcttcctgtttttaaagtatcgtaaaaggactttttaatatccttttgaatttcaaatatcattttttcatctgttttgtttatggccatatctctgccgaccttttgaatggcttccgcagtagtattttttctatatttgttaagtgttaaagaaattgtatttgcaagctttctttcgattttagtaagagggatgtcttccccttctccaacctgtgaaggtgtatttgtttttgtcattttatagattttaatatccgttcccgcactcattggaacaagctcacttacacctaaaacctcctgtaattccttaatgttagatactattctcgatgtaaaatcaatagaaatagcaggttctaaatcagttgttaaagtcgtattagtttctgctgcatatttttgtaaattaattttattcatatttttatctctccttttcaaataaatttatattttctctaatttttttctgtcttaaatttctgtctttaatcttaaaaatgtcctctttagttattccgggaacacttcctgcttttggagtattcccttttagtctttttgtcacttcttcttcaaccgtagaagtaaacatttttgaaaaatcttccacggctttttttgttccttcggcatcggttgaaacaaacatactaagaagattatcagatatatttatactcttttgttcaaggatttctcttgttgtttttttcatttgagataacttttccttgtttttatattcttcaagttcttttttaagttcatccctttcatattcggctttttctctttcgttcatctgtgcaagtttctttgcttcgtcaatctccttgtcctttcccctctgccatttttcaaatttcttgtttataatcctgtctaaatcttcgtcggtatattttgccttactttcttttacctcctcgtttttttcttcttttgtgctttcattttggttttgctctaaattttcgccctctcctgaaaatctttgtaaattaataaaatacattattttctcctttccatattctttttttagtcttaaatgcttggaccccatatctttttaagtcataaatgcttggactttccatacctttttatgtcttaaatgcttggacaataaaaaagagctacctaataatttctacattatttggataactctcttctaagttacataaagaaaacttcaaaaaatcatatacatctttgttcttttcataaagtttataattttctattaaactggatactcccgcacacacaatatcatatcctttaatggaataattagcgtgtccctttgcttttatctctaagctttcatcatcaaacaaaatacttatcaataagactttttacctccttttcttcctttgttcccttaattaaaaaaactacctcttccccttttaaaaagtaggtagtcggcagttttaacaaaggatatttatttgttatttcactgtttttatatatgtcatagtttttatattttactcctaaattatcaagcaccctttccattttcctgcagtgcgggcaccaatttgtggttaaaataataatatttaaatcttctttcattttgctcctttttagtaatatacatcttcttcattagataaatatccaagaatatacacatctttttcttcctttatacaatgctttaaaatttcttctattttttctatccccatgcttctaaaaggaaaagtaggaaaatcttctttaaaaagttctttatatttatctaaaagttccttgtttattatcatgtttagttcctttttaattttttaattaaaatatttaaatatcatactgtcaaatgacgtcttataaatagcatccataaatttttcgttaaaactctctaaatactcatagcattcatcttttgaatttagtgctttacctaaaatctcagcgactttttccatttcatagctttctgcattcacaggtatttctaagcctgttcctttatattcttctataccggaaaacaattctttttctttttcgagagaacagtcttccataagaagccatattcttgttttattccaaagattatctaattctttttttctctcttttttcatccaatcataactccttttattgtaattgaccaatcatcatttaatattacattttcaatttttatttgaggtctatcaaaaattatttcagattcttttttatttgttgtaatatatccatatcgttcctttggaacttttattttcatatggattctttttttctgcattacatttttatctttaacagctgaagtactcataaaagccttttcttggtaaattctaccaatctcaacatctgaaaccacctgttgaagttcttcccatgtttctttcttatttttaagcaaagacattttagggaatttaatccctgttatgctttcgaacccatcttcttttatatgtctataaacaattatatcactatttattttattttttcgtataactgaagataaagtatctgaaattttttgaaaatcgtatcctaaagtcttaccctttctgattatatcatttatatctttggcattacttgaattaatataacctgaaaaatgactacgtccgtacaaaattttacgttcttctttacttatagaatgatgcatatttttaaactcatcaaaagaaacttctttataatctctatttgaaatattatcatagttatcaagcctgtttttaattatatccccgcttttgctatgtttactttcataatcatcaagccacttatcccaattatcaacaactacttcaaaactgcacctgcaccaagggtgaaagggcggaaaatttattccgggagttctttccgctatgtcaaatacttttccttttatacctttgcatatgctacatactctaccgtctcccacagtagaaatctcataactttcaaaatcttcttcaaagggtgttatggtgctttcgtttaaaacatatgtgccttccgtaaatatcagcctgtaacagtcatttctcgttacctttgaaaatctttcctttaaggccttaacgcatttatcataactgtcgcctcttgctactgcctgagcgaaatctttatttaaataatccgcaagtttctttttgttgctccaaatcctatcggaaaagttttcttctcccgcataagaattattaaggattttacttattacgttgctgtttattgaaagaaagttctttccaaaccccaaggtttcgtatgttatgtttgcaccatttaatgtatacttttttaaatgcttttctatttcttcttgttcaatagctcctatttcatactgctttaaaagaatggaatactctagtccctccaacctgtttagtttatatatgttttctctaacgggcaggatatttttatactttggatatttctctataaattcatcagccctttttattagcatatccttttcttccatagatagactttgaagaaggtttctgtattctattatgttattttctccgtatctttgataaaaggaagctatttccttttccaaacttaccctttctttgtcataaaaaaaagacaacttctttttaagtttgtcttcatccttttccatattcttttttagattttcatatctattctgccagtaattcatctgtttcctctaaggttctgtttgtgggataatcggtattataagaaatactgtcgttttcttcttccattttctttatttcatcatccacattatccacaatgcttaatacttttaactgtgtttcctttgatgttattccactaagctgacctgctattgttgcttcgctttcaaggtttgcgggataattaaaatgaaattcataagaaagagtaagttctgcatcctttggaagtcccgtaacactcacatttgaaaatataatattatatcttctgttcattccggcaataaactttctctcttttgtctttgcaaggttgctcatggcaagaagtttatatttaagagcaatcccggagcttgttccaaaattctcgtcgcttatgtttgccaccattgatatttggtaaattaatctttctaacctattaatgagattttcctgtgtagtgtctccgcttggtttttgcataaattccactgttaaatcagagctgtcaccttcaaagtttataaccctgttgcttcttatatgttttatgctcttttcgtcaagctcagcccccaaaacctttatatatgcatctgcgaaataatcaacatcgtttgccttttccgataatgctttattatacgcatcaatcataggaagaacattttcaaatattccctgtctttcttcgttttccaaaaactcgtttacgggtatggttgaaaatccatgaatactgccttcatctaaaaatctgtatcctccttcactggtaaagcttattttatgattattggtataaacatctccgactatgttctcatcgctgtctttatagtaccttacaaagcatatggctgaagagtttatatcatcatcgtatatcataaatccctctaagggagagaagaatgatattgccattttaccaaagtcatcaatataatatatttcataaccgtgtccgtatatatcgcatattttactcagttcgctgttttggtcctcttgattattgtaactttcaagggttttgatgtattcattaaccttttcatcactagatatagtctttaccggaatacccataaaaaagccgttcattgtatctgtaatatattttgcaaagtttacggatattctgttatcaggcttccagggctccttttttttcatattatatattttataatcgtttaggtatgcattttttaatatttcatatctgcttttagcaagttcttgatgtttatttatatattcactgattaaatctattgttacagccgttcctttaggctccatgaacttaacataattttgaatcttactcattaaatccctccttttatttctttatatgttacctttttatgatatttttccaccgcatagcgaagagcatccattaaatgattgaaatcatcaacgggtctgtttattttatttccaaacttatccttatcccaggtgtagtttgatatttccattagaaagtttacacatcttggatgaattattattttgtaattttgtaaaaactgtatgccgtgcattatgctgtcttttccttttaaagaagctcttactttaagaccgtagtttctaagctcgtcaatgcttttaggctctgcactgtcagctgttatcttttcttttttataccccatatctcttatcctttcatatatcatcttgtttgaaagcccttttttatataattcatcccatatgaatattctcttgtcctttttatcaataaagccaataaaaaaagcggtggggtcgtttgtataaccaaaatccagtccgcttatggtatcaaagtttattatgtctttaagttcaaaagctttttcttcaaagttttcataaattagtccgtcaataatcccccagtttccaagccctgccacttggtatcttcttgggttgttctttttcatgtcttcaaagagttttatatcgctactgtccagccattcattacatttataagtagttgtaagaggtaaaatatcatcatcatctttaatatcaaaaaacctcttttttaaccagtggtgctcattccaggggttaaaggttattatccattgtttaaatagtccctttggcagttttcctcttatagattcatccagtatgttaaaatcctcttcctttgttacttcatatgcttcttcaagccaaccaaaacacaaagcacctttttctacggttatggaagtaactttcagtggatcatcaagccccctaaaataaatcttctgacccgttggtttataagtcatctcaaggggagataatttttcctcccatagatactcaactccaagcctttttacagcccatttaagctccataaagcatgaatctttcaaggttctgtatgtctttcttacaacaagggtatttgctcccttatacttcatcatgttgtatattatctttatggcacttgtctttgatttcttacttgccctcgaaccttttaccacaaggtatcttcccttaaatctaaagaactcaccgtaccctttgccgataatatcgggaagataaacatcccttttattcaaggtcatcctctcctttaaatacgggaattgttatatctatatttactccgttgtcgtttttattattttgtcctcttgtatctcttataaattccattgccttaatatttccaccaagtgcttcacttacgcccttaaacattatggcaacatcataggtaacatctcttttatttattgaaagagcctttgcaatgtcttttgcttcattggtatttaacctgctttctccgatttcatctaatatctgtcttaaaagcttcttttttcttctagcctttcccgatgcaataccgccttttcttgcaatttctctttgttcttcctttgttctttcatttaaaggtattaagttattttcttttgacatttcatttttttcgctcctttctatttttatggttcatatagtcttattttctccttttaactaaaaaaggacagacctaagcctatcctttaattattaatttttttattgcttcacttgcactaagtccttcacttttaagcttttctattttgtcaattatttctttatctgtaatattatcttttctcaaagtaatggaatatctttcataagttttcttattatatctattctttacttccgtactggtgaaggtttttctttttgattctttttctctatccatgttattaaatacctccattaaataacaatttaattacaaaatatagaaatgccaacaacccaactaagacaattacatgaccgattaatcttaatacatcttttttcatttgcttttatcgttatggtttgatataatttcttataggaaagggctaagccctaacctataagttttaataaaatcaatatccacccgaccagtgatattaattttaccaagagcttttcaagtagcaccactatcttgattagctcttttattttttcatccataactacctcctttctatgtttatattatactacatactgtacagtatgtcaatatatttattcaatttaattattctttttttatttatcctcattatgtatgcttaatcccaattatttcaatatggttaggaattaaaatgatttttaaattgcattctttaaatttattattaaagccactaatggcttcatagctcattacatctgtagcttttaaaattaatatatcatcatcatttaattcaataactttcatactatatctccattctttttcatcactcaaaaccccaaaaccttaaccgtgatgtcgtttcccgatattctccgtaaataaaaaagacaaagaatttatctttgccttcttttgtttatattattatataacgtttttattataatgaagtccttatattgtccaagaattgtttaataaacaaaataaataattttattttactctttacttatttcatcaaacatatcaattaaaggagctactttcttatttgcctcaatataatctttatacgctttattagcattttcaattaaattatcataataaactaccctagtattatatgatgctatagaattataaaatttctctaattcagtttgacttaaatcttcaacaagtttacctaaaacaacaacaatttcaaaaggtacattttcttgtcctgtatttgataaaagctttcttattgcatcatgatatttagtaatttggctatatatatcgttccttgaaactcttctactatatcttttcaattcaattatgatatgcttccctgccgatgttttataccctatatctaatcttccttttatttcttcatcagttaaaccatttatattttctatagataaagcattttttactcttttttccatatattctgtagaactagctctttcccatgctggatccaataaccataaatgctcaaataaatattgttggataacattttctaaaacatcaacttcagtaatttcttgaaatttttttataacatttattctttcatttattatttgataatataatgttgcttctatatcatctatatcatttaaaataaccattaaattatctaaactctctaaattcaaatcatcaattttacttaagttattattatattttaatttttcaaatgctaatatgctatattttaatatctccttctttttatcttcatcaactataatttgattaacattacctaaaatactttttgcatattttttatcatcccctttaagttcatccatccattttttaattgaaggataaatacttatagcctcttcaacccccatttcatttcttaatgaagtcccttctttttgtatttcttttaaaacgttttttataaagttctttaaaaattcaaatcgttcatcttccacattatattcttgtctactacttgttgccatatcttcacaattatcatcttcaaaaaaatcagcatgtatttcccctattaaatatttagaatataatccaccttcattatatatatctaaaatattttcttgacctaattttcctctaacaattaaaataattttatttaaattttcatcaccatcttttaatgcacctgcttcttttacagttcctatccatccagatacataataatttttatttttttcaacttctccacttaaatacttttctttttttacattttcaaaataaggcttatattcattatcatcttctttacatccaatataccaaacatattctaccttatgaaaataatcacgatctttaatttgtacttcttgatcatttacgtaaactttaaatttatatttattacctaagacactaaaacgtcttgctatacgttttattaaaaattggggagtaatagatgatatacgtttttttaaatcttttaaaataatttttgtacctataaaattatcaccttcatagataatactatcaggatgataacaaacattatcaccatcatactttatcgcatcttttattttttctaaattcatattaaaaccattaatactaccgttttttgatgtataaatatctatatcatttgcaatggaaaacatagaaagtttacctataccttttcttcccataacaggtctactatactttgctgttatagcttcattatgttctcttctctgataaccaacatttaaaaatttattgtttatatcatctatgtccattccactcccattgtcttgaataataatatcattattatctgttatatgaatatgaacttcacttgcatcagcatcccatgcatttgctacaatttcagaaataaccgaaggtatattactatacaaattaattcctaaatgattcagtacatttaagcttaatgacattgtgtatttatcttcaatattattttttatcataatatacctccaaatgcgatattattgattcacctataactttacctaacgtaacagggactgcattacctatcattttccctacttcatctaatggaatttcatctttaaaaaatttatattttttaggaaatgtctgtaacaaggctccttctctaaatgatagtgctctattttgttcaggatgaccaaaacgtcctgttccatatgacgtaaactgagttgtaattgttggagaaggtttatcccattccattctagcataaacagaagaataactctttccactatcttttttatgacattcacaaattaaatcttcatcccaatctttccatgtacctccaggtttagattgttttattctttctaaattttttttggaaaagtttctagctctatgtaaaggatcttttctagaaattgcgccggcttctaaaggctctaaatctcctataatttctcttaccgtaatataattatctttatctctcgtttttggcattaattcaattttaccaatttttgatgctagtaagactaatctagttctactttgtggaataccataatcaggacaatacactttatcccacgaaataaaaaaaccttctttttttaaattattaataaaagatttaaaaatttgttgttgtgataaaagagggacattctccattgaaataatatctggctttagttcattaataagtcttttaaaatgattaattaaataccatttctcatcctttttattttttttatttctaatttttgttgtatgttttgaaaaaggttgacatggagcacatccaactaaaactttaatatcagcatttttataaaatggcattaactcttctgcatttatatcttcaattttagaatgaataaatttagccttattattaaattcaaatgggaacttacaatattcattaaaatcaattcctgcaacaacattaataccagattcctttaatccacaggtaagaccacctgctccacaaaataaatctattgccctaatatccattttttttccttttcttttaatattataataattaattattttaccatattttaattatttgttcaaataataatcttttattttgaaacatctataccatacttctctaccacaacaatttcctttaatatacgttttttcaaaaatatcagatttatctaatgaatttaatattgaatcgatattatttaaaggatgtgatctttttaaatttagcttgcttgcacattcctcaaatataaaaggtgtccctttccatatatattcaatatctttactaagcatcaaatcttttatacattcagcaatggtataatacataacaattctccttttaataattattataatagtatatgcaataaaaaaaattattttataaaaaaatataacaaattaaagataatactttcttacgcatcacataataattacttttactaattcccagctccatataaacctcataatccctacacctaaaaaaatacttcccttcaataatctttcttccagtatcgtcaagcagctctaaacctttttccaccctttcacaaaatatctcattaagccttatccttttttctattctttctcttttttcaagataacttattaccttgttttcggtgatgttatttatattagaggtatttactttcacatcatcaaaacttacggaaaaaatatctcccgtaagccttaattcttttaattttaatttgtcggtttctatttgttttttccttaaaggatataagtaaagtaccctttcgatgtcttttgtgttcaacccatacctccgattaaaaatagataaaaaagtaaaatcattccttttatgtaaaaagtagctactattaaaaatactgatattagaaacatcaatataataaaaattactttcttcacattcctccttacctcctttcattttcataattcatattaaacaaacttatctttaacttttaatcttcagccctttcctttgcttctttaactttttttaaaaacacttcatctacttcttttttagtaagcttctttttgcagcctttaatattacatcctctacgcttacccattatgcataaataattacaataattagttccgttgccaaatctgcctaaaaagatacaaccactacagccttttaaaagattttcttcattctgctttgatattttaagtcttgatgccatagctcttacggtgctttctcttttattaattctccttccaatttcggttgcggaaagtataccgtaattattcttaaaaaaatctatctctatttcactccaacgtcccattttatttctccaaacttatcctcacagttgtttcgtcgttatttaataaaatacctttaaaactcttacagtaatcatttttatattttgtactcttgtttttatagcaatatatgtaatttatcttatctgtatttttcttgtgcttacagttttcgcatttaatttgcattagtaatctcctttcataatctttaactcctctttaacttcgttgttttctatgtattcatcaaaggtgaactcttcaagtctctttacttctgcctttaaacctttaataatttgctttagttctttgttctcttcctttaactcatcatgtttgttttttaatcgatgatattttgttttgtatattaaaaaatcaatcatacttatacctttctttattactgcatcatttttataatgtctttttcatcgtaatattcataatcaatatcagctttaattgtttcttttgtgctattaattttcttgactttttcgttttgttcccatgattttatacttgctttccagtctgtcattttattcttacctacataccagtttttactttcataaaagttatagaactgtagagggtttatattattttttctcttttggcaatactcctctacttcggcaatagtaggtttaacaaacttacgctgcttatatatattttctttacttttatttactttactttcctttactttactttgttcttctttgcatacatttttatcatttatgtatgcaaattcctcttcttcgcctgcattttgataattttgtataccattaataagaaggtattcttttttaacttcaacgacctttcttctcttaactatggtaaaatatcttttttgtattccctttgaagttaagatagaatatttgtcgtataattctttgttaaaaataccccttttaagagctttattgattatctcggaaacaacaccgcaaccaactcctatatcgtgagaaaacaacagcataacctccgagttccagtgacagaaataaccttcagcataaatcttttgataaagttttattattacaccaaagccttttaagccaaattctgcctccaagagtttaaaattatcgtccaggtatacatcaagaggaaaatagttaacgccatttttcatgatgtactcctttttaaaagacagcattgcaacccttatttgaacagcaataccaccttataatattcttttaatttgaggggaataagtccacaaggagaaacctccttaaatttttatttatataaacacgtcccctcttcgtgcttaaaacttattaatctataaatttatgtatggatactttttctttaagttataaataaattgtttcttttcaagctccaaagcctgtatattattatttaactcaagtacatgatccataagcctttccatatctagagtgaaaagcataaccttattattatttttaagtgcgtttatcatctcttcaaatatgtaacttacctgtcctttgtaaagcccgtttacaagtaccaaatattcatcataaacatcttttttcatcttttacccccatacaatataggcaatatatctgccaataatttctgcaatacacattgaaataatagaaaataaggcagtaaaaaatatgtacttgaaattaagttttataaatgataaaatttgtaatagtaacatatgtttaatctcgtgtctttgtttcccagcaagcacgggatttttatttatctttttcatatctttacccctttttttcttccatttgtatagatacatcaactattccgttaacaatcttttttacctcttcatcggaaatattaagcattcctttaagattatcaataataagttttaatgaaaaaaccatatcaaaaaagcttatctcctttgaaatttccattgccatatctctacttttaaaatcctttttaatgcaaattatatcttccatttttcctcctaaattttaagtacactatggttcatggtccttatgctatcccacaatatttatttttttaatttaataagatactcatgtaaaccgtcagtgtaatctccttgtttttcttcttgtgaaaatatataaggcattgccgagtatgacattcctataacatcaagaagtttaaacatatcatctcttgaccactcatactctcccctcattcgctttataacatagcttttagtcttgccaatcatttccggcaaatcaccagacattgtaatatcacatcgtctaagccagtacttaagctcagggaacttggtttttctcattgacattttcttctcctttctcttaaagactaaaatcccgaccgcaaatatatatatgtaaatttggaggatacaaaagcagtaggacgcagttcttttgtgatcggggctttagcctttaaggaatttaatcgttaagtttagaaaaatgaatctaaacttatattgaaatagtcggcaatagctttaatgctttctattctaggcaccctcttttccctctcccagtactctatcgccctttgacttacacctatttcctttgccaaagttaaggttgaaataccgtttttttctcgaagttctcttattttctttcctattgacattacttttctcctttttaatctttttttaattgactttgtttaatgagttttttataatatatatagaacgtatgttctaaaatgtaaatactttagaaaggtggtgaaactactatgacattaaacataagcgaaattatttcaggtatagctttaattatttctgttacatcaacaatatctggtccattaattaattcaagatatcaattaaaaatcaaaaaaattgaattatttcaacctaaacgaatagaagtaattgataaatacattaaaaatgcagcattaagaattaataaatattatcatgatgaatttaagctgtataaagaccgtgttcttatgtacattccagacaaaaatctacaatcacaaatagttaaattaaaccaacttattctcaatgataaatatgaagaagctaaaccattattagaagaattatcaactgaactatctaaattgatagatataaaataatgcccatattccccacataataaatacaataactgcgcataaaataggatttaatgcaccctcatatttttgtaatacggttgcgtttattattattgctataatacaaaacaatgttatagccacaaaaaaccaatccatctttttctactcctctaaaaaataattaatatccacgccgaaataatctgcgactttttttattttgtcaattttaggtttacttttaccatgtttccattctgaaaataatgttggatacagtcctgtttcttttgctactctataagccgaaatattttgtttttctaataatttttcaaatttttcatacatgtccatcaattaatacctcctttctatatttttaatcaaatttatattgcaattagttagaaaattctatataatatataaaagattaaatgtgattattaggattttctaacttacagtaagattatatattagattttcctaattgtcaatatattttattagaattttctaattttatattttaggagaaatacaatgtataaaatttattgtcagctcagagataaaaaaggagtaaaagatgctgaagttgcaagaaatacaaaaattgctccgtctgtattttctgagtggaaaaagggtaaaagtaatcctaaacaggataagttacaaagaatagcagattactttggagtaagcatagaatatttaatgacaggagaagaaagaacaactattacacaaagcccccacccttatataccaattcttggtaaagtaattgcaggagttcccgttgaagcggtggaagatgttataggaaagatacaaataaacgaaaatcttgccaaaacaggtaacttcttcgctcttgaagtaaagggagacagtatgcagccaagattacaagagagagatattgtagtggtaaaagagcaggcagatgttgaaagcggacaaattgccattgtatgtgtaaacggcgatgaatacactataaagaaaatcaaaaaaagcgaaagcggtattactcttataccatttaaccctgcttatgaacctatattttacagcaatgaagaaatcgaaagtttacccgttgaaatcaaaggacgagttgttcaatttcatggaaatttgtagaacaagaagcaaatatcaagaaaggatacaatgccatgttcgataacttcaaattaacaaagcaaagagaaaaacaattaaaagaagagattaaaaaatcaaaagaagaatataaagcattacaaaaacaaaaaaaggaaaaaacttcaatattcaataaatgtaatttatgtggcagcagaaatgttgttttaaatgaatatggggtatgtcaagcatgcgaaataaaacaattaaaaaatgcccttcttccagaatacaataatcttgaatatttaacaaatgaaattgaaaaagaaaacataaccctttccaaaataaaacaagaaataacagaaaaagaagataaattaaaatctttaattcaaattgataaagaaaatgaaactcttttaacattaaaagaagaaataagtatttgtgagaaaaaattaacatctttaaatcaagaaataataataaaagaaaaagaagtttttacattggatgacacaattttacttcaaaatttcggtttatatgaacctacatatgactttgctttatcaatagaatacaaagaagaacttaataagataagaaacaaacaaaaagaaatggtaagaaacaaaacggcagttgaatattatgacggctggacggttaacggaagcaaagctgaaggcagaaaaatgacaaacagcaatataaaacaaatacttcgtaccttcaacaacgaatgtgatacattaattgaaaaagctaagtttaataatattgataaaatcaaacaaagaattgagaaatcatatgaacagctaaataaaatgaatgcttctgtgcaaatcaaacttacacctgcatatttaaaattaaaattcgatgaattaactcttgcttatgaatatcaagtaaaaaaacaacaagagaaagaagaagaaagagaaagaagagaagctttaagagaacaacaaaaacttgaaaaagaaataagagaagcaagaaataaaatattgaaagaaaagaaacattttaacaatgccataaaagaggcacaaaaacaacttgagctaacattagacgaagatgaacgaacaggacttttagataaaataaaagaacttgaacaacagctaaagaatattgacagtgaagaaaaagtaatagattacagagaaaagaacgccaaagcaggatatgtttatataatttcaaatataggtgcttttggagaagatgtatacaaaataggaatgacaagaagactcgaaccaatggatagaataaaagaacttggggacgcatccgttccattttcctttgatgttcatgctctaatattctcagaagatgcaccaaaacttgaaagcaaactacatgaacatttctttaatgacagaataaacaaattaaacaacagaaaagaattttataaaacaaaacttgaagaaatagaaaaagtagtaaaagaaaattatgataaaaccgttgaatttacggaaattgcacaggcggagcaatacagacaatcaattcgtattaagtaaaagatggaatgaaatatagcaacgtttataatttaaatttataaaaggaggaaattgttatgaaaataggattaagaacaccaagcttaaaaaaatcttttaaagcaagaacaacaggcaaattaaaaagacaaatgaaaagaactattaatcccatatacggtaaaaaaggtgtgggaatgataacaaaccctaaaaaagctgtctacaataaagtttataacaaaacaacagtaggattaaacgatataataaaatcatctccaaacaaacaaaataaaaaatcttctatcgtacaaaacataaatacggcagaagatacatcatggaaacaagaagcagcaatgtggaacagttatgacagagaagtaaaacacgttgcagatagatattttagtttacatcataaaattgaagaaaactggtcaaaattatttcaatcaaaacaatataattctaaattagccgatataattgaaaaagactgtataaaagatattgagtattacatggaaatgagaaaaatagacataaaatataaacttagttctccaaacgatatacctgccctaagaagacttgccatgttatatgaaaaacaagggcgatatgaagaagcagtaaaagcatgtaataatgcaatatctcttggaatggatgaacataaaaggcttgagagaatattaaaaaaacaaataaaaagttttaaataaatatagaaaaatagtaaatattaaaaaaatatttaattaagtataaaaatagttccagtaagtgaattttttctaaagatctttaaaaattattgaattctttaagcttattacatataataataatgaaagaaccaacgtgcctatgttgtttttcaatatgcgaaccagttggacagtgtggatgagcttactgaggtaggctcattttttttaggagaaataatgaaaataaaaaaggcaacaaccgtagaagaacaaattgatattttaaaaaatagaaatatgattattgaagatgaagaatccgctaaaaattttttattaaatattaattattatagatttaccggatatacttatctctttagaaatagtgatgatacattcgagcaaaatataacttttaatgaaataaaaaaaatttataaagcagataaaaatttaagaataatattattcaaatatatttctattattgaaatagaatttaaaacccatatagcttatgagctatcaaatgccattcaaacagaaacttatttatactatagtgatgatttatatttcaacaaagaacattttgaacaattcaaagaaaatttaaatattaataaagagaaatcaaaagataaattatttattaaacattataatgaaaagtataatggcattcttcctttatgggttgcaacagaaataattagtttaggtgatatatctagattttataataatttaaaaagtaaatatgcacaattaatatcaaaacattattacaatattaacgatgatacgttaaaatcatggtttttcacaatttcatctataagaaattcttgtgcccatcataatagactatataaaacacatctaaaagcagtacctaaaaaccatggaagtttaaattttaaaagagatatatctagtgcaattattattattggtgttttattaagaaaagaagacagaaaaaaatatattgaggaaataaatgactttatagaaaataatagaggatcattattttcagctaaatcagcttatggattagataagaaaaaatacataaatgcaataaactctattacataaagccaaagtaccttaaagcaataaaaactcctctacctcggcaaaggtaaaagagttaaaataagtgtcattgacacctacaaatcaaatatattataagtcaatggcactctaaaatcaatagaacaaacttcgaacatgaaaggagtgttatttttatgcaaaaaagaataaatactgcaaaatggaacggaacaagatggagaattgacgttcaaaaagatggagtaagaaaaagtttttacagttcaaagaaaggaagaaacggacaaagagaagcaaacaaaaaggctgacgagtggttagaacaagatttaataacagatattagaatttgtgatttacaagaaaaaatgattgaagaaaaatggcagatgaaagaaatcggctccagcagatacgcaagatataaaagtatttataattgttgggtaaaaccaataggaaacaaaaagatgagagagcttacacaacaagatattcaatccattttaaataaagcatgtaaaaaaggaaaatcacaaggaactataaaagaaataaaatcatggtttaacgaactttgtaaatatggaagaaaatgcaaggtaacatcacttgttccaatagatttatacattcccaaaaaagcaaaaaaactacaaaaaagggacagtcttacagaacaagaaataaaaatattattttcgtcaaacaaaaccacagtatacactaaagtatgtgaagatgattatataaatttatatagatttgcctgtattacaggtctaagaagaggcgaaattataggtcttaaatggagtgatttcaaaataaaggataattatactctaatggaaataaaaaggtctataaatgaaaatagagaaattacatcaggtaaaacaaataatgctaaaagaaaacaagtattacctcaaatagcagtaaaaatattaaaaaatcaaaaagaacttttaaaaaaacataaaatcatatcaagttatgtttttccggatatagatactggaaattttattactccagacagaataacaagacgatttaataactatgtgaaatataataatctaaatgacagaataacacttcattggttaagacacacattttttacaaatctctattcttatattgaagaaaatattctaaaagaaatgggaggacacgccgagaaaatggatacgggtatatatattcatgcaacagataatcagcttataaatgcatcaaaaagtgtcgataatatatttgaaacactaataaaataaagtgcggtcaaaagtgcggtatttttataatattttttattttaatacccacaaatccttttatttaaaggcttttaataagaagttacctttccatcactcgcaccaacttaataatttaaaataaaaaaacaaaataaccaaaatacgcagacatgctatattaaaggattttagaagatgaataattcgagtaaataaatttcaaaagacggaaatatcgtctttttttattcttataatttttattaaaattaatatatttttatgatataatatttactataaaatggaaacaatataaaacattttatttcacaaaatattctaatacaataatataataaaggggaaatgattatgaaaatgtcaaaaaaagaagaaaaaagattaaaagaagaaattgcacaagaacaggctaagttaggtataccgccgaaaaaaaaaagcaaaggaaaaaagatagcaataattgtcggagtaattgttgtggttcttttacttctcgctatgtgtggcggaggtggtaatacagactcaactccaataacaaatgaagaaattactgaactatatacagacccttcttcatttacaggcagaacttttacatttacaggacaagttctttctgttgaacaagatggaaatgtatatggtattcaagcatggtatgatgttaaaaatttagataaaaatacattaatatactactatgcttctgaagatgaaaatttttcaataaaagaaaatgattttataaaagcaacaggaacaattaatggtacttttacaggaacaaaccttttaggcggaacagtagagcttccagaaatggatgctgataaggtagaaattgtatcgtatgaagaagttgtatcccctgcaaataaaacaatagagttagataaaacaagtaaaaaaggtaatgcttcttttactattgaaaaaatagaattagcagatgatgaaacaagggtatatgctactttaaaaaacaatggtagttcctctatttctttttattcttatgacgcaaaattaatacaaggcggagaacaaatatcaacacaagacgatttttacgttgaaggatatcctgaaatagaatatgatttaaacagtaaagctaaatcatctggaattataacattcccaaaaatagacaaagataaaaactttactttaaaattcccattttatgataatgaagatttcaatgaatatactttttctttcgatataaaggtaaaataatacaatcaaaaaatatatgaatataaagtcttgtatttttattaaaataaaaaacaaaggggcaaaatgccccttttatttttaataaaaaagaaaagcttaatgcttttcttcatcttctttaaatagtaaatatttttgtaaataaattttatttgcaagagactttgtcgcaagtcttacaatttttgcttcatgagtattgtttgaactttcttctacatcatcatcttcaataaatgcaattctaaaagctttttccatttctctggcaaaataatcataagcttcctctatcggatatgtatctatttgtatttttattaaatcacaaatttccgaaattgataaaatttgttttaatgaacaaactacaattatataggcaatatgatgtttagtatactttttctttacaggaggagaaaccaaaccttgctttacgtaattgttaaccatagatgaagttattagtttttctttatcatttattttaaacacttccaaaacatcctcggtaaaactaattacttgatccatatataattcaatatttggaagttcattatatcttggaaaatgaaattttaaaatttcttttgtataaactgattcttcaaatttattcatatcttactcctttttagaagtatatcatcatgattttatgttgtcaatagtacatgaaagctcttgacaaagtatcatatattatataatataatattaaataacagataaaataattttttaaattaaaaggaaataaccatgaacaataaagaaaaaatcgctattattaccgattcaggtacagacgttcctccaaaatatatcgaaaaatataatatgtatgttgtacctcttatagttaactatgaaaatcaaagctatagagatggaattgatatcaatataaatacaatatgtgaaaaattaaaggaagaaattccaacaacttcacttccttcaatagatgatatgatggaaacatttgaaaaagtaataacagatggatacaaaaaagtcatagttataactatctcaagcggtcttagcggaactcataatgcaatgagaatagcaagtgaatcctttgaagataaattagacataatgcttgtagatacaaaaaatatagatataggagcaggattcactgcaataagagcaggtgaacttattgagcaaggatattcttttgatgaaataaaagaaaaattagatgatgcaataaataacacaaaagtttatttttgtgttaaaacattagaatacctaagaaaaggcggaagaataggtcttgttgcttcagttgtaggaacagcacttgatttaaagcctgttatatcttgtaacagcgacggaatatattatgtagtatcaaaagcaagaggaagaaaaaaatccattaaaaaggctcttaacgaagctaaagaatatgctaaacaatttaaagaatataatattgccgttgtaaatgtatggtcaaaagaagaagccaaagaaattgaagataatataaaaaatgattttccaaacgtaaaaagcgtttttgtaggggctatatctcctgctcttgcagtccacacgggacctggacttattggagtcggagtgcaaaaaataaaataatacctaatgaataaaaagctgtaattaaatttacggctttttatttttatataaaaaaagaacataacaaaagttatgttcttatattttataatgcatttttagcaacttcaactaatttagcaaaagcagcttcatcattcatagcaaggtcagctaacatttttctgtcgatttcaacattagcttttttaagaccattaataaatcttgaataagacatatcattcattcttgtagctgcattgattcttgtaatccaaagttttctaaaatctctttttctttgttttctacctgcataagaacttcttaaagctctcattacagcttcgtttgcaggtctgtataatttagatttagcaccataataaccttttgcaagttttagtacttttttatgtttctttttactatttaaacttctttttactctagccatatattattaccttttaactacttaacaataatgtagctgattgttttttggtcagctgcagaaacgtagccaccctttcttaattttctttttctcttagttgtttttttgtttaaaatgtgatttctaaatgctttttttcttttgataacgccagatttatttcttttaaatcttttagaagcgcctctatgagatttcattttaggcatattaatatccgtcctttcctactatttttctttacctttagcaggttgtaatgtcattgtataattacgaccttctaacttaggttgtttctcaattgttcctacctcattaaccatagaagcaaatttcaacagtacttctttacctctgtcaacataagccatttctctacctctaaatcttacggaaacttttactttatctcccgcttttaagaatttacggcagtttttagcttttacttctaagtcatgatcttgtactctaacagaagttctgatttccttaatgttaacaactttttggtttttcttattttctttttctcttctgttttgttcatatttgaacttaccataatcgagaattttacaaaccggtggttttgcatcaggtgaaaccttaactaaatcaagatttctcttatcagcttcttttaaagcttcttgtgcagacattataccaagcattgagccgtcatcactgataactcttacttctctgtctctaatttgttcattaatttgaaaatctttaattgaatcatacctccatgattaaaaaaatagatagcaaagaactgctacctaaatatatcactaaataaatgtgtatatatttaccaaactaaatccatgtttgtttggtgagaagcaattcttctactttgttttctaaaagagtatatcactaaacccttttattgtcaatgattatttaatattttttatataaaagcatcttgcaatgcaagatgcttaaaaattaatcttcaaattcaaattcactgaaaaaatccatatcactgtcttttttaaatactactttatcgtcttcctttgaatctttttcatcaaaatttgtataatctatttctgaagaaaaaatatcttcaaaaatatctttactttgagtttttgcaggttcaattttttcttccattggttcaaaagtttcaaagtctaattttttactttcaactctttcactcttttgaggttcaatatcttcttccttaatatcttcttctacatattcattttgaacaacttcttctttggcaggttcactaaataagttttcatcaattgaattgtcttcaaaataattttcctcagttaaagtttcttcttcatgttcatccataatattagaatcttcaacaaaatcttcttcttcgatttcaacaggttcaacaaaatcctcttcttggaattcttctattacttcttcatctgtaacttcttcaggtattatttcttcaacttcttctacttcctcattaggaaaaacttcatctacaatttcttgagattcttcaacagcaacttcttcagtagcatttgctgtttcttctatacctgcatcttcatgttcttcatgtaactctttcattaatttttcttttgcaattgtaagtttagctaaatcttttaagaattcatctacagctttttcagttgttgcaaaagatgtacaaagtcttattacacttttttcttcacttaatttttcccataattcaaatgaatatttctttaaaagtactttcaaaatatcatttggaagaataggaaatacttggttcgttgcagacattgaataaaaaccataacctaaattaccaataccaagtgttaatttatttgcaagtctgttttcgtgtttacctatttcaaaatataacccatctttaaatagttcaacaaactgaacaccaagaagtctgccttttgcaatcattccaccattttgtttaatatgatatctaaaatcaacgttcaattcttcgttatttattacaagtgcttcaccgaataatgcacccatttttgtaccgccaatatagaatgcatcagttaaattagctaaatcttccattgtaacatcattatctacacaagtaagagctgaaccaagccttgctccgtctaagtataaatataagccgtacttatcacaaacttctcttaatttcttaatttcttctttggtataaatagttccaagttctgttggatttgaaatatataccattttaggtttaacacagtgttctctttcttcatcatcaaaatgtttttttgcaacttcttcaacgtctgaagccaaaagtttaccgttgttttcttctttaactattattttatgacctcttgcttcaatagcacctgattcatgtacattaatatgtgcagttgatgctgcaattactccttcgtgaggtcttagagccgaagaaataaaagctgtatttgttacagttcctcctgataaaaaatgtacgttgctgttttctctttttattaatttttttattatttcacttgcttcttcacagtatttatctgtgccatatccgctgctttgctcaaaattagttttgataagtgctgccaatatatttttatgagcaccttcactataatcatttgtaaaactatacataataaaccctctatctttcgtcataataactcataatatatgatataaaacttttatactttttacaagtaaaatatcaaaaaaaaccttattttaagcttaaaaaaggagatattttacaatatctcctttaatcttattttatataattcaaagcctttttaagtctttcaacaacttcatctttacctaaaatacttaaaatataagttaaatctgcaccatgcattattccgcttattgctattcttgtaggcatatataaagctttaccttttattttaaattctttttgaatagattttaaactctttgaaacaatttcaggtgtaagttttttttcttgttcaaataatgaaatcaagttttcaaacaatgtttcatttgtttccatatccatgatttcttttgctttatcatcaagttcatcaagatttgcttttaagtataattcttttgtaagctctatactttcttctaaataatttagcttatctttaatggcttcaacaatatattccattgtttcatcgctaacatcatcatttactaaattttcttttagtaaataaggcttaattaaagcaataagttcttcatttgatttctctttaatgtaatgggcattaacccagtttaatttttcagtatcaaaaacagcaccagcttttgttactcttgaaatatcaaaatctcttattaattcatccattgataaaatttcttttccttcaggatcagaccatccaagaagagcaatgtaatttatcaatgcttcaggaagataccctttttgtataaagtcttcaactgcaacagaatcatgtcttttacttaattttttcttgtttttgtttaaaacggttggaagatgagcaaatttaggagcttcccatccaagataattatataaaattatatgttttggtgtagaaacaagccattcttcccctcttattacatagttaacatccattaaatgatcatcaaccacaactgcaaaatgatatgttggaaatccgtctgctttaataagaacttgttcgtcaacatcatttgtatttattgtaacctctccccttacttcatcataaaaagtaatatcctcattttcaggaagagccattcttataacataactttcaccgttttttattcttctttcagcttcttctcttgatatgtttttacatttaccatcatattttggtgtttgtttattttgtacttgttcttctcttaatttatcaagtctttctttatcacaaaaacaataataagccttgccttcatctaaaagtttattgatatattttttgtatatatcaagtctgtctgattgaaaataaggtcccttatctcctatttcaacaaccttaccatcttttaacattggaccttcatcatgttttacaccgcaaaattccaatgcattaattaaattttcaacagaaccttcaacatatcttgttctgtctgtatcttctattctaagcaaataatcaccatcgttatgttttgcccacaaatagcaataaagagctgttctaagtcctccaatgtgtaaaaatcctgtaggacttggtgcaaatcttgttctgatattcataaaatactttactccttaattatttttccgtcttgccataatctttccagattataaaaatctctttcttcttttacaaaaatatgaagtactatttctccataatccattaatatccatcttgaaagttttataccttcttttccttcaagaaatatgtcgttttcctctgctttttcttctacaaattcacatacagcttttgcttgtctgtcactatttgcactcgcaactataaaagcatttgcttcggaagtcaaatccgtaacatcaacagcatatatatttgataatttcttctcttccaataaatttataaaaaattgtgttttatctttataattcattatttctcctaaatcttaaacttttaatgtaacatcataacctattaaatctttatttttttctaatacaggtttaacatcttcttctacaaattcaataacttggttaacagctcttcctacatatttttcaggttttaaaatatcgtggatttcgcttaattccaaattaaatgcagggtcttttgaaattctttcaagtaagtcgtttggtttaccttcttgtttaacaactttgcttgcttccatagagtaaaccctgattttttcatgaagttcttgtctgtctccacctctttttacagcttccattaagatgttttctgttgtcataaatggaagttcagccataatatctttatggattactttttcgtttacaacaaaaccgcttgcgatatttatcgctatttgaagaatagcatcacagcacatgaaactttcaggaattgaaattcttctgtttgcagaatcatcaagagttctttcaaaccattgtacgcttgctgtcattgctgggtttacttgatttgcaataatatgtcttgcaagagaacatattctttcgcttctcatcggattacgtttatatgccattgcagatgaaccaatttgatttttttcaaaaggctcttcaatttctttcaaattttgaagtaatctaacatcagtagcaaacttatgtaaactttgagcaatacctgcaagagcatttacaactctgctgtcaaattttcttggataagtttgtcctgttactgtaaagtctgtatcaaatcccatttctttacatacaaactcatttaatttttttattttttcttcatcattgttaaataatgacataaaacttgcctgcgttcctgttgttccttttactcctctcattctaaatgtagaaagaacaaattcaacttcttcataatctaaaagtaaatcttgaatccaaagtgtagctcttttacctactgttgtaagttgagcaggttgaaaatgagtaaatccaagtgttggtaaatctttatatttaattgcaaattcactcattactttaattaaatttacaagttgttttttaataagttctaaagcttctttaaaaactattaaatcagtattatctccgacatatgcactcgtagcacctaagtgaataataccttttgcaacgggaactttatctccgtaagtatgaacatgagccattacatcatgtctgaatttattttcgtattctcttgctaaatcataatctatatcatagatattatcttctaatgcttttacttgttcatcagtaatatcaagacctaattctttttcaccttttgcaagagcaacccataattttctccatgttgaaaatttcttgtcagctgagaaaatataaagcatttccttacttgaatatctttcgattaatggattagtataaacatctctactcattttaattctcctattttatttcatttataaattctttgaataattttaaaccactttcaatatcttccatacttgtcgcataagaaaatcttataaagtcatctgcaccaaatccaataccaggaattacagcaacgtatttactgctaagaagtgcatctgcaaaatctattgaaccatttatttgttttccgttatattcttttccataatatttagaaacatcggcaaaaacataaaatgccccgtccggctcaataggctcaactccatctacttcttttaatacactaagcatatattttcttctgctgtcatattcttttaccatatcatatacgattttttgatctgtctttaaagctgtaatagtagcatattgagatatactgcttggatgagaaacgcattgtccttgaattgtattcatcgcttttacaatatctttatttgcaagagcataacctattctccatcctgtcattgcatatgactttgaagctccgttgattgttattgtaatatcttttatttcatctgataaagatgcaacaggagtaaactctttatcgttgtaaagtaacatttcataaatttcatcacttaaaatgtatataccttccttaacacatacatcagcaacttccttaagttgttcttttgtatatacaacacctgtaggatttgaaggattattaagcataataacctttgattttggtgttataacctcttcaagttcttcttttgttaaaacaaagttattttctttctttggatatacaaatacaggcttacctcctgcaactttaaccatttcagaataacttacccagtatggaacaggaataattacttcatctccgtcactaatcaaagcttgcaaagcagtaaataacgaatgttttgcacctgatgaaacaataatttcactttcaggatcataatcaatattaaattcttttttatatttttcacttatagctgttcttaaatctataagaccttttacatcggtatatcttgttataccttttttcattgcttcgttagctgcatcaataattacttgtggagtatcaaaatcaggttctcctgtaccgaaagagtaaactttttctccttctcttttaagtttgtttgcctttgatgtaatggcaagtgtcattgatggtgatattttatctaatttgtttgataatggttttttcataaagttcctcctatattattaacattgcatctccaaaactaaaaaatctgtatctttcttttatagcttcttcatatgcttttagtatatcatctttattgtaaaatgcactaattaacatgagtaaagttgattttggcaagtgaaaatttgttataagatggtctattaccttaaattcatatcccggataaataaatatatccgtattcatactaacaggtcttatatctccatacttttgataacaactttcaagtgttcttactgtcgttgttccaacagcaaatatatcttttccacgtttttttgtatcatttattatttttgccgtttcttcacttataataaaaaattcactatgcattttatgattgcttatatcatcttctttaacaggtctaaatgttccaagacctacatgcaaagttacatagcaaatattaatgcctttatcctttattttttcaagcagttcttttgtaaaatgaagacctgctgtaggtgctgctgcagaacctttatcttttgaataaacagtctgatatctatcgtcatcgtcaagtttttcttttatatatggcggcaaaggtaccgttcctattttatctatataagaaaaaacatcatcgcagccaaaaaatttaaccttagccaaaccttcatcgtatttttcaacaacctgcattgataagttatcgtcaaattttacaattgttccattttttaatcttttggcaggttttatcattacttcaaacatattgttacttaaaggttttaaaacaaaagtttcaatttttgctcctgtttcttcctttattccaaaaagccttgcatgaaatactcttgaattattaagtacaagagtatcaccttcatttaagtaatctattaaatcataaaaatgtttgtgttctatttcttttgtatttctattaactaccataagccttgaaaaatcacgtttttcaataggtgtttgtgctataagttcttcaggtagattataatcaaaatcactagttctcatatattattcttcttccatttcaaatattgatttagtcatgatttcactgttcgtataaggaacatttaaataatcataagcaagttttgttgcaactcttcctcttggagttctgtttataaatccaagctgtaataaatacggttcataaacatcaaggattgtgtcctcttcttcaccaataacagcagaaagagtatttagaccaacagggccaccgtcaaatttatttataatagtatctaaaatagcaatatcactgctatcaagtccgttttcgtctacacctaaaagcttcaatgcttccattgcaatttctttatttataatatcagatttttttacttgtgcatagtctcttacacgttttaaaaatctatttgcaattcttggagtctgtcttgaacgaatcgcgatttcccttgcaccatcatcatctatttttatttcaagtattccagcacttcttttaataatttctataagctcttctattttatacatctcaagcttatttaatactccaaatctatcacgaagaggagaagaaagaagtcctgttctcgtcgtagcaccaactaatgtaaaaggtgcaacaggtatccttacggattttgcatttggtccttttcccattacaatatcaaaagcaaaatcttccattgctggatataaaacttcttctatggttctgtttaatctatgaatttcatcaataaataaaacatcattttttttaagtccggtaagtatcgctgcaagatctcccggtttttctattgctggaccggaagtaacttttatagatactccaagctcgtttgctattatattggaaagagtcgtttttccaagccccggaggtccatataaaagaacatgatcaagagcctctcctctttcttttgcagcagaaataaagactctcatcctttctttgactgtttcttgaccgatgtattcatctaatgtcaaaggacgaagagacttatctttttctatatcaagttctgtttttttacttgttactattcttgtagccatatttctccttattcattaaccctttgtaatgcaatagtaattatatcttctatagtaaggtcatcattagtagaaatgccactaacgattttatttgcataagctctatcaaaacctaaagatgtaagagctaaaacagcctcagctttcaaatcaccatttatatctatactatcttcaaaagatatttcatccatttcaggtaaatctgaaaatttatcttgaagagtaacaactatttgttcagctgcttttttcccaactccgtttgcagcacacaatgctttatagtccttattaattactgcacttataatcatgttaggcgacaatgcactaagtacgctaagcgcaattttaggacctattttaggaactgtaagaagtttaaagaatacttccctttcaaaagatgtagaaaacccaaataaacttatatcgttttctcttacagccatatatgtaaatatttgtacttcatctttatcatttgccaaatctgttatagtattttgtgaaacatttagtaaaaaacctattccacttttattttctattgttaaatatccatcagttatattagtaacatttccttttatataatcaaacattaataccctctacttgtcctcttcgtgtctttcataataaccgataagctttctgttttcatctcttaccgcaactatataattattttctttatgtttttcgttatatccaatataaatttccgttaaattatcatcttttaaaaatctatcaatatactcaagggttagtttttttgaattctcattatgacaatcaaacaaagacttccctatcaaattagctccgcctctatgagcataacgttttaaagcacttttattcatgtacgttataatatggtttgtatctacaaaacaaaccggatttttttcattatcaacaatatccttaaaaaccatgttaaaatccataatgataccaccttataaatatttatctatataaacatcatctatatgttctatatttatttttgcatttgtaattgcaataagttcatttttaaattcttcctgtaaatttatcggaacatatactccataagtaactttatcggtaaaaactgcatcttcaagtttataccctgtctttcttaaatacgtttcaatttttccgtgaagagaataatcataagaaatttttgttaaagctgtcattaccttttttacaagctttgcttcttttataacttcacttgcagaagaagaataagctcttattagcccgctggcaccaagttttattcctccaaaatatcttgtaaccactattaatgcatttgtaagattatttttttccatagcatttaatataggtctgcctgcagtcatagcaggttctccatcatcactggatttttttatttccattttcttacctattatatatgcataacaattatgagtagctttatagtgttcttttctaatttcttcaagatatttttcagcctcttcaacatttttaaccgaaaataaatttgaaataaaagtagatttttttatttctattgtactgttaaaattatcattaatggttatataatccatacataaattccctattttaattttttccgattaaatattataacataatacatttttttgttcaataaattgactttacaaaactatctattacaaatatcaatacctctaatttgtttaaaataatctcttaatctttcaatagaagaattaacaactaattcctcaggataacctacttcatttaataactttattgattcatcaaaatgtcctattgcagaagaaatatgtgcatctgaatttacaataataggtacttcatattttttacatagtttgacaatttcaaaacaattaacatcacttcccggacgctgctcaaaagagtgattatttacttcaactatcttattatatttattacattttgaaataatcatttcgtaatcaaatttaaaaatttcatttccaagatgaccaaatacatttatgtttttattaagcaaagcttcgctaagcatatcattaacatgatttttatcttttggataaaatatttcttgatggaaagatgcaatttttaaatcaagattttccatgtactcttcttctaaatccacattaccctcaggcattatgttaagttctataccacttattaaataaaccccatgcattttacctggattattctttccaagacttctaaaatgccaatgacttgcaccatcttccaaagcaggtccatggtttgtaataccaacggcttgtagccctgctttatttgccgcaatacaattttcttcaagagttgaaaaagcatgttcgctaatatttgtatgtgtatgtaaatccgctataattttcattttacacctcttatattttataatattttttattatagcataaaataaaagacatatttaatagcaatatatacttttaaataaattagactaattttatatttacatatttaaatttagctatataaaaaaatatatagctaaaatatatataatatggtaaaataaaaattatgtaaaattataataaaataattgtataggagaaagataatgaatattgcaattgttaaagctggaggtactggtcaaagaataaatgataaaaaagcctctttaccaaaacaatttattgaagtagaaggtaaacctttattaatttattctattgaaccattacaaaaagcaaacaatatagacaaaataataatttcttgtcatgaagattacattaatttagccgaagaatattgcaaaaaatttaatataacaaaattatttaaaattgtaaaaggaggaaaaactactagcgactcttttctcaatggattaaaggttgcaaaagaactaatgaatgatgatgatttagtaataatggcagatgcagtacgccctcttgtatcaacatcaactgttgaagaaatagttgaaaaagcaaaagaatgcggtgctgcaggtgggatggtaaaaattgccgaatgtgcatttatttgtgatgaaaaagatagtataagttatataggaaatgacacctcttatatgtctaaaactccacaagcaattaaattaggatatttagaaaaatataataggcaagcaaaagaaatgaatgtctacgaaaattgccctgcactatgcacattatgtattaataccaataatccttatgcaatcgtaaaggatagtccttataatattaaaataacataccaacatcaacttgatttctttgaaatgattgtaaaaaacggattattagaaaaaataataaatataaaataaggagaaaattaaaatgaatattgcaattattacagcaagtggtagaggtacaagaatgggtgaagaatataaagattcacctaaacagtttttagatgttgaaggaaaacctgttcttttctactgtttagaaaaatttgaaaataataataatattgatgctatcattatagtaacattaaaagattatatatcttttgttcaagataaagtaaacgaatatgatctaaaaaaagttaaagcaattgtacaaggtggagatacattaaaacaatctataatgaaaggttttgaaaaagctaaagattttatgtcatcagaagatgatacaattgttattcatgatggtgttagaccgatggtttttgatagtgtaataacagatataataaaatcagcaaaagaaaaaggaccttcacttactggtataccaaataaaacaggaaattttatgataactgaaaattctgaagtaaataaattttatacaaaaaatcaagtatatgcaggaggaacacctcaagctctaagtgccaaagatcttcaatatgcatacaatgaaggaataaaaagaaatattttagatgatgaaaattatggaacatgttttatttctctactatatactttaggaaaaaaaatctatatagttcaagataaagaattaatgaatctaaaaatcacaacccctgccgaattagaaatatttagagctataataagaattagggaggaaaaaaataaataatatgactttaagcaaaaaagatcaagtattaaatgttataagaaaaatacaattagaaggtttagcagaaattgatagaatatgtagaaaacataatataaattactctctgggtggtggtacttgtcttggagctattagacataaaggatatattccatgggatgatgatattgacatcgatatggacagagttgaatttgaaaaattcttagaagtttcaaaatatgaattagatgaaaatatcttccatcttgaatgtaatgaaaataaccccaatttttattcttacacaccaagattaatgattaacaacaccattttaaataataaatcaatggaattaagtggaaataatcattgtatatttattgatatctttattcatgattatttaccaaataataaaattaaaagagcatactacgcaaaaaaaatctattggataaaagtattaacttattataaatggtatggcattacaaaccaagtaccacagtcatttaagactattgcaagaatatatgtaaaacttagaagttataagcacttcttaaaaaaatttgacaaatatgcaaagcattaccataagaagggtgaaaaaacaaattatgtaattgatacttcaatcataaatggaaattttggaggatttccttcgagtataaagaaagaatatatagatgttccatttgaaaacttaacagtaaaatgtttaaaagaatatgacactttcttaaaaatattatatggtgataactacatgaaaatttttccaaaagaaaaaagaatttctcaccataaatggaaaagagtagatcttggaccttatgcagaaaaatatggacttccaaaagaatatgtaaaatatatcataatgaacctagacgctccaagattaaaaaaagtaaaacaagtatcacttgaaatgctcgatgtaattgataatatatgcaaaaaatataatattacttattttgtttgtggtgatgatgctttatataaagcaaacaatacagaagaatatgcaaaaatatggagagatgatgttactgttttgatggataaaaaagcatatgataaatttattgaagttgcacctaaagaattaaatcattattatttcttagaaaataatattacaaataataattatcatttcccatattctaaattaaaattaaattacacttattttagggacagaagaacttttccagcagatgtaaaccaaggattatggataaatattggtgtattaattaatacttccaatgatgctaaaaaacgtttaaaacattatagagcattaagtaatgtatatgatcaaattagattaaaatggctatataactctttaagagaaaatgtacaaaaagtaagtgttttttataataaattaaaaaaaagtacaaaaagtaagcaaaaagtatacaaaaagtaagtataatttataaaatttttgttaaagagtacaaaaagtaagttgttttatataggagtattaaaaagtatacaaaaagtaagttcttttaaaaataattttgataatagatacaaaaagtaagttaaaagtatacaaaaagtaggttatttttataataaatttaaaaagagtacaaaaagtaagttgtttttgatataaatttaataagtgtatacaaaaagtaagtatggttttttcctttttgaaaagaggtacaaaaagtaagttaaaagtatacaaaaagtaagttgtttttgttgacattttttgacaagtaatgtaaagtattaaaagtgtatacaaaaagtaagtagtaaagatataatcgaggatttagaatgagcgaaaaaaatgatttaatcaatttggaaaacagttttgtaacgcaggttacaatgcttaacgttgttgccgaggcaagatatgatatgcctttggtttctcagaaattatttatagaagcactttccagagtcgatattgacagtgatgatttttcagttataagaatagggcttagtgaatttgcaaaaagaaacaacgtaaacaaagattatctttacagagaaaaggagaatattacatctaaaacccttacggctcaaataatgataaaggatttagatactgatagctacactcaaaagaatttattctctcagtgcagttataaagacggacagtttatttttgaattctctgaaaaaatgaaaccgtattttttagatatatattctaagggcggttattactttaaatttataaaagaatatatttcaagattcaaatgtaaatatacaatgaaactttatcttctttgtcagtcaaatttatataaatgtcaaagaaatcaggaagttagtttttctcttgatactctaaagagtttttatgatataaaaggagggaaatattcttcttatagaaattttaatgaaagagtattaaaacctgcttttgaagagataaacgaaaaaacagatttgaacgttgagtatataccggtaagaaccagcggaagaaatattgataaaatcatttttaacatagtaagtaaaaaactacttgaaaatgcaaaatatactgttactgacagtacattcaataatttccttgattttattaattatgataaagatgaagataaaaatataaacaataaagtagaaatgtttaaaaactggcaggaaaattatgatatatatttgattttctatgtttccgaaaaagcaaagaaacttgcaaataaaaatattttcagttatatagacgtaagccttaaaaatacatacttaaaaggatataacgtatatgaaagtttatttggaaaacatgaagaacaaacttatataatgacaaattccgaaacagaatcctttggagataatatgtatatagattatctttcaaaattcgataaatatattgcagataatgaaaataccgcacaagatatttataataattggagaaaaaacgtacgaaaatcctttgataatgctcttaaattttgcaatgacataatggtaagcatagatgaagaagacgaaaatgttatcttaaacgtaagagacagaataaaacaaaaggatattatgtcaaatgaattttttgaagtttatactgatataacttcaaaggttaattatataaaagattatattagtaagagcggaatgaacataaaagagggaatggaatttttaaacggaataagcatggatatacttgatccgacacttgaagatgtatatttcaaaattgtatctttaaatgaaaaagaaaagaagatgaaaaagaaaaaattatctaaagcttaggagggagataaaatgaaagaagaaattcttataagagcaatgattgactataataaacatgatccaaagagaatacagcatttaataaaggtacactctcttgcaaaaacaataggaattcttgaaaatatagataaaaaagatttatttattcttgaaactgcagcaattttacacgatataggaataaaagtaagcgaagaaaagtatggtaaatgcagcggaaagctgcaggaaaaagaaggtccaaaagaagcagaaaaaatgcttgaaaaatttggatatgacagggaagtaatagatagagtatattatttaataggtaatcatcatacttatgataatattgatgggattgattatcagattttggtagaagcagattttttagttaatatatatgaagataatttaaacaaagaaagtatagaaaatattaaaaataaaatatttaaaacaaaaacgggaatcaattttatagaaaatatgtattaaaaaaaaaagcaccgttaggtgcttttttttagttattgattaatttatcgctttcgtcattccagctgtataatttacggatttctttacctacttcttctgatggatgttcagcagctaattttctcatagccctgaagtgaacttgtcttcctgcatcagacatatcaagtaagaattctttagcaaatgaaccatcttggatatctgaaagaacttttttcatagcttctctgctttcttttgtgatgattttctttcctgttatgtaatcaccatattcagctgtgttagaaatagaatatctcattccttcaaatcctgattggtaaattaagtcaacgatcaatttcatttcatggatacattcaaagtaagcatttcttgggtcatatccagcttcaactaatgtttcgaatccagcttgcattaattcgcataaaccaccgcaaagtactgcttgttcaccgaataagtcagtttctgtttcaatacggaatgttgtttcaagaacacctgctcttgctccaccaatacctgctgcatatgcaagtgcgatatcttgagctttgcctgttgcatcttgttcaacagcgattaagcaaggagtaccttttccttctagatattcagaacgaactgtatgaccaggagctttaggtgcaatcattgttacatcgacatttttaggtggaacgatacatccaaagtggatattgaaaccatgagcaaacattaacatgtttccttcttctaagtttggttcgatatcttttttatacatgtcagcttgtttttcatcgttgattagaatcatgatgatatcagctttttttgcagcttctgcagctgtatatactttaagtccttgttgttctgcttttgcccaagattttgagccttcatatagaccaacaattacgtcacatccagattctttaaggtttaatgcgtgtgcatgaccttggctaccgtaaccgataatagcgattgttttaccatctaataatcctagattacaatcttcttgataaaatattttaaaatcactcattttaaaaacctccgtatttgtatgacaactttatattacttgtatgatgtttattttaaatggtattcctaatattgtcaagacttttctgaaaattttaaaaaatttttattccaagctttattactgtatattttatgttttattttaatttattttaataaaaaaagacttcatatatttgaagtctttaaagttcttctgtccaaaaagcatgatgcaaatgtatggtaaccgcactttttaatgcttctgaatctcttttttttaggaaattcattatcatagcatggtctttgtatgcatcttttgcaataatgtcaagattatagtttagggcaaatgttttttctattgtttgtgtaagtaccggcataaatgaacttataaattcgttgtgagatgcttttattattgcacagtgaaagtcattttccgattttattctttcttttgccgttggattttgcaaaattaaattttgacatttttctccaagttttaatatttcttctatttctttgtcgcttgctcttttacatgcaagggcagctgcacttggttcgaatatcattcttgtttcatataagtctctaagggtaatcttcatatcagtaaacgaatttatccccatatcgttttttgcatatctgtttaaagtatcatttacgaatgttcccctgcctctttgaacatctaaaataccttctgaaacaagagttttaacagcttctcgaagggtagaacggctaactcccagtttttttgaaagggaattttcgtttggcagtttttctcccgttttatatattttttcttttgtaattaaatctcttaatttatcagcagttatttgtgttaagtttttcttttcttcttgcatgatatttctccgaaaacattaagtgtatattgattataagtaacttgtctgatgtttgtcaagagttatcatacaaatatttatattaacacattataaatacctatcataataggaattgtaataatagataaaagtgtcgttaaaacataaagactgcttgaatattttgcatctaagttgtatagctgtatcattgaagtaaccgttgcacaggaaggagtaacacatgcaagataaactatcattaagatattttttccgtctataatataactcgatgcatttgttatatataataaaaataatgtaattaaaggatatattataagccttaagaaacatataaaataatatcttgttttcttaaatagatttattatggaaacttcccccattaccattccggctattaacattccaataggtcccatcatagaacctaatgtatctacggtatcagttataatacttggaagatttattctaaatataaatatcaacattcctataaatatagaaataatatttacatttaaaattattttctttatttcaattttctttattcctttaagaaggctgttacaatgtgtccaaagaagtattagttgaacaacaataaaagcacaagaatatattacatattcttttcctaaaatggaacttataagaggaataaccaatatccccgcatttgtataaattatatttactttttccgctacattaaaattaaatattttatttaacattgatgtaagaatgataaaaagaatatgaaccaatatagaaattataaatgcaaatattaaacctgtttttattttttcatcatattcaatcataaatgagtttattatcatacagggagttagaagatacacaagtattgcggatatactcttgctgtcgtctgattttaatactcctacttttacgataatatatcctaaaaacattattataaaaagttctaaaatttcttttgctaaaattaaactaatatccatgttctgtccttttttaattaaatatagttaaagtatagtataaataaataatctttaaaagataaaaataaaaagtctttactttaagtaaagactttaatttatatttttttgaattttgcaactgatgccatgaatttttttattcctgttccagggaatgctgctgtgattttcatgtcatctccgcttccttcaatgcttacaacagtaccttctccccatgcattatggtctattttgtctcccgggctaagtttttcgtcaaatgtattgttttgtttaaaaagattttgtgtttgtcttattgtatttgcataagggtcatacatctttttaacattgttattaataatttctttttccttatttgattcttttattgcactgattccttcaataagttcatcgggaacttcaagtaaaaatcttgaaggatttctcatttcgtttcttccgtaaactcttcttgtttcggctgaagacatataaagtttttttcttgctcttgttattccaacatagcaaagtcttctttcttcttccatttcgctttcttcgtttacggctctgtatgtagggaataaattttcttccattcccggcataaatacaatgttaaattcaagtccttttgcattatgaagagtcataagcagtaccttagagctgttttcatcataagaatcaactcccgcaacaagtgctgcattttcaaggaaagcttcaagagaaccatcttcttcgttattttcaaaatctcccgcagcatttacaagttcgtctaagttttcaagtctgttttgtgcgttttcaacttttccttctttaagcatttgttcgtatccgcttaagtgaattgtgtttattacaatatccattaaagagttttcttttgctattctttcaagttcttccattgtgtctttaaataaagtaagtttttcttttacgcttcctttaaataaagggcaggtttctatatcttttataacttcatacatggatatgcctttcatgaaagcataatctcttattttttctatgcttgcaggacctattcctctttttggggtattgattactctaataaatgcaatatcatcttttggatttactaagagttttagatatgcaagaatatctttaatttccatacggtcatagaattttgttcccgcaacaatttgataagggatatttcttctcataagaccttcttcaagtatacgagattgtgcgtttgttctgtataaaattgctatgtcactatatggaatgtcgtgatattcatttaagcagaatatttccctggcaataattgaagattcttccaaatccgaatttgcatgaagatattttatgatttctccttcttcattatcggtaaacaaagttttacccattctctttttattatgctcgattacaccgtttgcggcatttaaaatattctttgtacatctgtaattttgttcaagtcttattattttggcatcttcaaagtcatcttcaaattctaagatatttcttattgatgcacctctccaaccgtaaatactttggtcatcatcaccgcatacacatatatttctgtgaccttcagccattttacttattattgcgtactgagaaatatttgtatcttgatattcgtctacaagaatatatttgaatctatttctatatttatttaatacttcaggacattttgcaaaaagaatatttgtatttaaaagcaaatcatcaaagtccattgcatttgcacttaaaagtcttttttgatattcactgtatatttgtgcaattcttgcctctgtatatccttcgtcaaaatctccatgctcgtccatgtagtcgtcgcttgtttcaagatcgttctttagtaaagaaatttgagctttaacgctttctaccggaaattctttatctgaaatatcaagctctttaagtattgtttttaaaagtctttttgtatcatcatcgtcatatattgaaaaattacttgtaaaccctagattatccccttccattcttaaaattcttgcacaaattgagtggaatgttcccatccatatatcagaagtgaaaggaatacccattgagtcaattctttccctcatttctcctgctgctttatttgtaaatgtaagagcaagaatttcccaaggttttgcatatccattttctattatataagcaattctatgaattattgttcttgtttttccgcttcctgctcccgcaagaataagaagaggtccgttaacacaggtaacggcttgttgttgtttatcatttaacatactaagtaagtccattttcattctcctcgtaagatattaaaggaagtgttattataacatcagttcctttattttcaatgctttcaatgtttatatttccatttaagtttgtaactatccatttagctattggaagaccaagtccgctgccattttttcttttgcttctggctttgtctactctgtaaaatcttgtaaagacttttttgatttcttcctttttcattccaattccttggtctttaactttaattgtaatattattttttgctttatctacttttagggctgctataatatttgtattttcatctgaataatttaccgcattgtctaaaagtatcatcataagctgtgtaaacttatcttcatcaacatttgcgataactttatcatatgagcagtacatataagctcttatttgtttttttattgcaataggctctattttttctattgcgtcttttacaaggtgtactatatcacattctttattgttaaatgggatttgacctaaatctgcttttgaaagagtaagcaaatctccaaccattttatccattctgtttatttcactttttgcatattcaaaccacatttcctgtgattttaccgtttcattttcgtttgtttgtataagttcaagatttgttttaattaccgcaataggtgttcttaactcatgggatgcatcagcgataaattgtttttgattgtctattgtatctttaattggaaccaaagctctgtcggcagtgtaaaatcctccaagaagagatataattactcccactattattgcaattaccaaagcggaaagaattatattaagatttgaattttgctgtgtgctgtcttttgccattaaaataagctgcatatttccgctatcgttaattacaagagttgtgcagcttctaaatgagatattgccataagaatagtttgtaaaaacatacttcccgtcttgttcttttatttctatgtttttatcgtctggatcatagaaatagcagtaagcaatatccgcaaaaatattttcgtcaacgttcattttgccatagctatatgtttgatttaagttttcgtcaaaaataacgattttacatttacctgcatcaatttgttgtttaaaatattttaattcttcattataagataaatcacttgtgtttttaaaattgctttttgtatatctttttgcttgatataccatattaataagttcattatcggaagactcagaaaaggaataagatgaaagcaagtaaataaaagcagtcattgaaagtaaaatgaccagtaaaacaaaagtatttattaaaattaatttattttttattttatttatcattgtttttttcctttaaggaataaccaagccctctttttgttactatttttacatctgcgtcgcttgataattttttccttaagtaatgtatatatatttcaacgctgttatctattgcataactgtcaattccccatactttatcaagtatataatcttttgataaaacatggtctttgtttctcattagggtttcaagaagatttgcttcttttttggttaagttttcctttctttctcctaccgtaagagatgcatcgtttgtgtttaggcttacgtttcctatgcttattatatcatcagagatacttccctttcctcttcttgacaaagctttaattcttgctataagttcctttgtgtcaaaaggttttgtaaggtaatcatcagccccaaggtccaaaccttttactctgtcgtctatattgtcaagagccgtcaaaagaagaatcggagtatagttgttttcttctcttaaagtttttaaaacactaagtccatccatttgaggtagcattatatctaaaactataacgtcatatatcatttttcttgcaagcattaaacctgattcgccgtcttcaacggtatctgcaagaatttggtttttccctaaaagagcaaccaaaggtttagccaacgtaacttcgtcttctactataagtactctcatattaatctttcctttctgcttttaatattataattcataaaattaaatttaacaaatttttttacaatttttaattttttaaggtaatttaaaggttttaatcatataataatgacatataaggagaaaagggagtgtttatatgaagtgtccttattgttctagtaaagaaattggtaaaattggaagaaagaaatatttttgcagtaactgtttttcagaaatagtagttaattccgataaaatgaaagtaatttcattaaatgaaaaaggtattgcgaaagttattaaaacttgttcaatagctgattagcatagataaatttagaagtaccccttaatcccctcaatgcttctaaaaatctattacagattatatagtaaaaagcagcttttaaaagctgctttttatttttttattctataaaaccaaactctttatctatttggttaagtttttcaaggtcgaaaggtgtagtttggtatacatgataatttaaccagtttgaaaaaagcatatttccgtgtgctctccatctgactattggttttttagtatcgtcatcatctgggaaataatgttttggaactttaggatttaaaccttttttcttgtctctttcgtattcttcttttaatgtatttggatcatattcgctatgtccaaatacaaatatttttctttggtctttgcttacaagtagataagcacctgcttctttactgcttgcaacaatttcaaggtctttttctttcttaatatccttaataagacactgggtatgtcttgaatgaggcgcatagaaaacatcgtcaaatcctcttactatcggtcttcttcttaaaactctatgctcgaatactccaaacattttttccggaagatcttttttgtctattccgtagtaatgatttagggctgcctgtgctccccagcatataaacatggtggagaaaacatttttatctgcgaaatcaaaaatttgttgaagttcttcccagtagtttacatcatcaaattcaagtttttctacaggtgctcccgttataatcattccatcgtattttttatgttttatatcatcaaaatttttataaaatgtttttaaatgcttgtaagacgtatttttacttacatggcttttcatattaattaagtcaacttttacctgtataggtgtattacttataagccttagaagctgtgtttctgttactatttttgtaggcatcaaatttacaatagcaatttcaagtggtctaatgtcttgtgtttctgctctttcttgatgcatgacgaatatattttccctgtcaagctgttttgccgcaggtaaatcttttggtattataacagccatatttaaacctcttttctattataaaaattactttattattttttgatagattgcaataataattttttatactagttcaagagctttatttaaatcttcgataatatcatcaatatcttcaataccaactgataatcttattaaatctggttgaactcccgcttcaattaattcttgatcattcatttgacggtgagtatgacttgcagggtgaagtactgatgttcttgcatctgcaacatgagtaacaattgctgtcatttctaaattatccatcatttttactgatgcttctcttccgccttttaatccaaatgcaattacaccgcatgtaccgtttggcatatatttttgtgcaaggtcataatatttatttccttcaagtcccggataattaacccatgcaactttttcgtggttatctaagaattttgcaactgccaaagcattttcgcagtgtctttgcattctaagatgaagtgtttcaagtcccaaatttaaaaggaatgcattttcaggggattgaattgagcctaaatcacgcattaattgagctgttgcttttgttatataagcaagtttaccaaatctttcggtataaacaagaccatgatatgttacatccggagttgtaagaccggggaatttgtctttatgtttatcccagtcgaagtttccgctgtctactattgctcctcctacacatgttgcgtgtccgtccatgtattttgttgtagaatgagtaacaatatctgcaccccattcaaaaggacggcagttgataggtgttgcgaaagtattatcaataattaaaggtactccatgttcatgtgcagcattggcaaatttttcaatgtctaatactacaagagctgggtttgcgattgtttctcctacaacagcttttgtgttttctttgaatgctttatcaagttcttcttttgatatgtctggatctacaaaagtacattcaactcccattttctttattgtatgggcgtaaaggttatatgtacctccgtatactgcagttgagcaaataatatgatctcctgcctgagcaatattcattattgcataaaagttagcagcttgtcctgaagatgtaagcattgctgcaacccctccttcaagttcgcatattttctttgcaaccatatcgtttgtagggttttgaagtcttgtatagaaatatccttctgcttcaagatcgaaaagttttcccatttcttcacttgttgaatacttaaatgttgttgattgtattataggaagaattcttggttctcctgttttaggctgatatccgccttgaacgcactttgtgccttgttttttatttgtaatatccatatttagtcatctcctgtataaaagttaatgtaaaaataatcttatcaaatattttgttataagtaaatatataaattattatttagaaatagattttatctataaccagttataagattaacaggtcataaaatatatttgtacacttaagatactatataatttatatataatgataaaatgaaaaattaaaatgaaaaagaaaattttaaaatgtttatgtgcttttttagtttgttaatgcttgtttctttatccgcatgttctaatacgggacctgaagagacttttaatgagtatatacatattattacaacaggagaggactttgagaagctttttgaaataggaactatggagagaaattctaaggaattatttgagcaatcagggctttctgtagatgaatatatgaatgatattactaatactaatttagatgaagatacacaaaataaattaacatcaaagttatcatataaaattgtttctgtaaaacaaaatgagagcactgcaacgttaactgtagagtttaccaatatcgattattctactttaatggacaatataatggatagactttttgattattcatcagaagatatggctaattttagtgaggaaaaaataaacgagcatatagaaaagttatacgaggaagagataaataaaatttatgaaaaaggtaaaatggcgacagttacctatgatgttaatatgataaaggaaaacggaatatggatggttgaaagcagccctgaattatatagtatgatttatggtcaaatgcttaattataaaaatatggatagttttaattactaataaaaaaagaggggtaacctcttttttattttatataaaatttacttgtatccacaccttccaattccaaaagctttatttttttttctattcctcctgcatatcccgttaagttgccgtctgatccaactaccctatgacaaggaattattatgctaatggggttatgagaaaccgctcctccgacagcttgaggcgacatgttttttttgttcatttttatttttaccttttcagatatttctttatatgtaatagtttctccgtaaggtatttcacatagtatacttagtacttccatttgaaaattgcttgcatttggttttatttttaaatctacaatacttggttttcttccactgaaataatcatcaagccacaattttgttttatttagaatttctatatcttcattttttaaaggggtttcttttattttattcatgaaatatttttgaccttctatatatagacctattaaatatttattatcgcttataagggtaatttttcccacaggtgaataatatgtatcatagtaaagcattgattttctccttgtatattttgttttaagttttattttaaatgtaagtacaatatattatttaattatactatataatttgatttgaattatatacgatgattatttaatattacttaaaaaaaagaggcttaagcctctttttatttttcttttattatttttttacttgaaaaatatgtaataagaaaatatcctccgtatattaaaattattgctattgccgttacgattattgaaggaagaatattcatatgccctattgttgaaagaatataatcggaaaattttagtccgaatatggagtgtacaatcgcaagcatcaaaggaagtataaagaatattcctatttgcataaataaagctttgtttatcattttttcgctggttccgatttttcttaaaatcttatatctttcaatattgtcagcactttccgaaagttcttttaatgcaagtatagccgcagatgtaataaggaatattattccaagatatataccgataaaagtaaccgtggctccaagtccttttgaagattcataattatacattctagttgaagttgatatgttgattccataatcttcaacatctttaaacccactgttttcatctatttcttttgtaagtttattttcaaaatcagctttttgttcttcatttcctaaattataatttgcattaaagtagtttatttccttttgttcatttgtaaatttagtactgtcgggaacaattattatacctaaatttattgcttgaattgaatcttcgataaatccatcgtaacattcacttacagaaggtttataagttttgccgtttattgtaatttctgttcccatctttaatgctttgtttctgtaacctgtcatcatgtcatagttacaaactactgcatattctccttctttaagacttatttcttcattcccaaaaactcttgcgattttattataatcggaaactttcattatgctttctgctgcatcaaattgtgccgtaggggtttctttttttatttcatctataatactttttaaagtatcttttaatgtaactgtgtctgcggtataagtgcttacttcattgaagtctttaaaatcattttccacatcgtatcccatatcttcaagtacttcatttatgcttttttctgaaaagtcaacggcagaaggggagtactctccgttatttggtaacatcattgtttttgatatggttatgtcaacgggattatattttgtaagttcacttgtaagagacttattcatagcaagccctgctgagagcatacatattgttgtaaaaagcattaaacatattatgctcattgaaacaaccgtagtgtttatttttgagttaatctgttttagtacaaacatattaaggtttttgtagtaaagtcttttacatgattttacaagttttaaaacaaatccagaaagagagaagaaaaataaaaatgttgaggctgctcctattattatatattttactatatctccctgagataaatctaaagtgtcaattgttactttataatatgcaaatccaagcataatgattgaaatgataaatagtaatacagaaagaaaaggacttctcatttttattttttcgattctcttactgcccgttattaagtctattaatttatatttgtttattacaaaagtattgaatatcattacaaatatatacattaaagaaaagtataatattgttttaaaaagtgccccagaggaaaaaacaaatttgaattcgttcatatccgcttcaaacatactggcaactattatagacataaactgggaagcaaaaatgccgagtattaaccccacaaaaagagatattatacctataaaaagagtttccaaaaataatatttttgaaagttgccccttacccattccaagaataagatatattccaaattctttttttcttctttttattaaaaaattatttgcgtatattatcaaaaatccgagtacgattgaaataaaaacagataatccggaaagcatttttaccattaagccaacaacgtcataggatgattttgcaaaattttgtattggttcttgtgcatccatggaattgaatacataaaatactgcaatacctaaaataagtgtcatgaaataaatggcataatcctttatgctttttttaatgtttttcatggataacttaaataacatcgttaagctcacctccaagaagtgtcacaacttcaattattctgttaaaaaattcttttctgctgctgtctccttttagaatttcattaaatatttttccgtcttttataaataaaactctctgtgcttttgatgcggtaaaagcatcatgtgtaaccattaaaatcgtggctttaagttttttgtttagaagttcgagactttggagaagcattttcgcgctttttgaatctaatgctcccgttggttcatcggcaagaataagtttaggatttgttattattgctcttgcgcaggctactctttgtttttgtcctcccgacatttcataaggatatttatcaagcacatcttctattccaagggctctcgatatgtttttaactcttttttctatttcatttactctcattttttgaatggtcagtgcaagagcaatgttttcatatgccgtaagagtatccagtaaattaaaatcctgaaatataaaaccgagtctgtttcttctaaattcgtttaggtgtttgccttttaggttggttatatttatatctccaacaaaaatatcgccgcttgttactttgtctattgttgatattacgtttaaaagtgtcgttttcccgcttccgctggagcccattattgcaacgaattctccgttatttacatcaaaacttatatcttttatggcttttgtaagatttgatttattgccataatatttttctatattttcaactcttaatactttttccatttttttctccttaaatgtattttgcggtgatttcgatttctccgctgaaatcttctcctataatgcttaaataatattcaccatccgttagggttaaatctcttcccccgctttccggtccttctatatcaaaacttgcgataatttttgtttttgaatcgttttttaccattaactttgatttccctttttttatgtccgctttatattcgatgtttatattttttgtttttctgtttacttccacggaaccgaatattacttcttttatattttcatctttatataaagaggtatacttgccggtgtttgtgtctacataaaaaattctttctcccattaagtcttcatcggaagttaaaaatttttttcctataagatttagtatatcattatattttgttattaattgatttttgtttatgctacatcctgcaaatataacagacagcgagcataaaattattattgccgttttctttttcatgtctttcctcctttctttaatttgattatagaaatgcggggaagttttatccatcgattaaaattacataaccttacaattttgtaaggttatgtaattaagtttattttaattattaacattcctcattttgattgattttttatagtatttataatataattaaattgcttacttttcatggtgtgtaccattacatatatggcgctccttgaaccctttgtctcaatcggggcaaagggattttttatttgaatttttataatatttaatccgaaacccgtgtaatataatgtaaattattttgctgtaaacacgtttttttattaacattctttctttgtcggtttccataacgtttgttgcaatattttgtaattaaaaagtttaacatttaaaatttcatatagttcttaaatatattttattattactaaatatgatataatatttataaattttacattaataatgcaaaacaggtgaaataatggagaatatcgttttaataatagactgcggaactcaaagcataagagcgatgcttataaatgataaaggcgaaattttaataaaagaaaaagaaaaatatgaatacataacaaaagaaaaaggaagtattattgagtttgacgcaaataacttttttgaggaaataatttctcttttacttaagttaaaaagtaaaaacgaaaaactatattctaagataaaaggggtaagcataactactcaaagagatacttttgttttggtagatagaaacggagctcctttaagaaatgctatttcatggcttgacagaagaaaagcagaaaattataaaaaacctaatatattatatagaatgcttttttctttagttggtatgggagccatgactaaaaatttaatgagtgaagcaaggtttaattggattatagaaaatgaacccgaaatatgggataagacatataaatatttgcttttacctcaattcctaaattataaatttacaggcaaatatattgaaagcgatgcgggaactgttgggcatattccttttgattataaaaaaagggagtatgataaatcttacggaattaaaaggcagctttttgacatagaccaaaggaagctcgcaaacgtgattccttcgacaaaaataataggaagtatattggatgaagtttgtgaaagagcgggaataaaaagaggaactcctcttgttgcaagcggaagcgacaaagcttgcgaaacaatcggagtaggttgtataaaagaaggaataggcagtatatctttgggaagtcaggttacgatacaggtaaccacaggcagatattatgaacttacaaggtttgttcctcctttttgcagtgtgattccaaatacatataaccctgaaattattttatatagaggtttttggcttgttacatggtttataaaagaatttgcttataaggaagaacaaatatgtaaagaaaccggtaaagatatatatgatgtaatggatgagaagttaaaagaaatacccgtaggttgtgatggtcttattcttcagccttattggggacaggatattcttcgtcccgaagcaaaaggaagtatacttggatttaatgataaacatactagaatgcatatttacagggcaataattgagggaataggatattccttaaaagaaggaatagagagaattgaaaaagtatctaaagttaacatagataaaatagcattatcaggcggagggtcaagaagcgacataatatgccagataataagtgatattttaaataaagaagtttataaaattcaaacctatgaggcaagcggtataggagctgctatggcaggttttataggacttaatgtttttaaagattttgatgaagcaaaagaaaatatggtaagacagacaaaaacattttctccaaatgaagaaaatgcaaaaaaatataatgatatttataataatgtatatttaaaaatatataaaaatgtaaaaaaaatatatacaaaaatgaataatattaatttatagggggaaaattatgccacttaaaagtacagttgaaaactacaaagattatatggggatatctccaaaagcagaggattttgataaatactgggcagaaggagtaaaagatttgaaggaaactgatttttcttatactcttgagaagagggatttcccaatgaaagatatcgaaatatacgatatgtattttaaaggaatgaatggggaaagagttcactgtgaacttgttaaacctaaacatattgaaggaaaaattccgggagtaatgtcattccatggttacacatcaaatgcagacagtatttattcaaaagttccatatgcatataacgatatggcattcttggcttttgaagttcctggacaaggtggaaaaagcgaagataactacactgctgatggacctactctttatggtcaaataataagaggcgtaatggatgaagacaagaaaaaattatttttcagaaatatttatcttgacgccgtaaaagcttttgttctatttgaaaatatggatttcatagacgaaaacagaattggcacaacaggaaaaagccaagggggagcactaagtcttgttgttgcggcatttaataaaaatgttaaggctagtgctgttatttatcctttccttgcagactttaaaaaggtttttgaaatgaatatgtgtgaagatgtgtatgttgaatttaaaaattggtttagaaaatacgatacattacacgaaaaagaagatgaattttttgaaagactttcttacatagacgttcaaaattttgcggataaagtaaaatgtgatgtattattctttacggcgcttcttgatacaacttgtccgcctataacacaattttcaatatacaataaattaaaatgtaataaggaattaaaagtatactgcgaatatactcatgaaagacttccttattcagacgatataatatatgaattctttaaagaaaaactttaattaataagcaccctgaagttaatattcagggtgttttatttttgttaaaatttaaaaaattattaaatttgctcttgtatgtctaaatattttataaaattaatatgtctataattattaattttaattttattatttttatcatatgcagggataagttgggaatatatttaatatataaatataaaacgtttcgatgttatagtattattttatattaattatttttctctttttaatggaaagttagtgtatatatttattaataaaaaaattttttaattaatagaacttgtaataccttttaagtaatttataaaagctgaacatgatataagcataaattttgcttcttcaaatgttgcgtctttgccgtctaattgtcctgtatggcgtattccagaagcatcactagtatatccatataacttttcaaaggctgttttaagtgaaggatgaattgtaatatttttctgttccattttttttaaagcagctcctaaagtatcgcttttacccagtatttcagagcatatagcttcaacagaagaaatactttcttttattgaatttgcataatctggatgatttctatctgagattaaagtcaatgctttgtttaaatgtttagttgttttttgaaatggtacggttaatgcttcttctatagaatttatctcattattatcagtaattgaaataattattccgttaatatatctatatccaacatattctttttctaaaatatcattaatatattctttaactgaacaacctgaatatctattatatatattttctttttcaaatttgtttgccataaattctaaaatagttaaaacaatatcataatcataattagctatagtgttatttattatttcaaacatttttttttctatataataagagttgcctgaataatctactggttgttggtatacttgacttaatacatctatccataaagcatttttcccatcattatcatatttatatacattatgatataatgcattaatcccattcataatggctgtacgtgtacnnnnnnnnnnnnnnnnnnnnnnnnnntaaaataggtgctttatttgatttcaattaaatccctcctaaatttattataatgaattatagttagtttatttttataatatcataaattttttataaaaatacatttttctacatcatatataataattttattttatgtttattaaaatttaaaaaaaattattaaatttccaaacaagtttttatattttttgtcaaatttaaggtataaaatattaaaattaaaggtaaaaaaatacatttgattaggctaaaaccctttatttaaaagggttttggttgtttgaaaggttttagataaataaatattataaaattattaatttgtaattaaaattatataattctattgacaaattatataatcaggtatataatttagccaaaataaaggaaaggtgcaggtaaaatgggaaaaagtgtatatagtttagtattaatggatgaagtcgtagaaaaagttgatgaagcggcttataaaatgggtacaagcaggtctaatttaataaatcaaattttggctgattatgtatcatatacaacacctcaaaaacaggttgaaggaatatttacatcccttgaaaatatgtttaaggaaatgaatacttttcaagttttagctaatccatctccttattttatgaatataaccagctctcttagatataaatacagaccaaccataaaatacggagtagagttatatgacaattcaaagtattcatttggagagcttaaagttactttaagaacgacaaatcagactttaataagagatatgaacagatttttgaatttttattcaaagcttgaagaaaaatatattagaggaatactggaggataatttatgttacaagatagaagaaaagaaatatacaagacaatttgttttaccaaaggaacaaggtattgacaaagttgaccttggagttttaatcggagaatatataaaggtatttgacagcgtgttaaaagtatttttaaatgatcttccatatattgatgacgcatgctccgatgctgaaaaagagtatgttactttaatgcaaaaggttcatgcaattatataatgattatttaacataaaggagggttttaaaatgaatgcaaatgactatactgaaaaatcacttcttgcacttcaaaatgcacagaatttagctatagataacaataactcggttatggaagccgaacatttattatacgcattacttgatgacagaggagggcttattcctgaacttcttgaaaaaatgcaggttaatgtatctggattaaaatcggaagtagaaaataaaataaaatcttttcctaaagtttcatcaagcagcgtagataacttatacgcaagcaacaacttaaatagagttattcgtcttgcagaaaatatagcaaagaatatgaaagacgaatatgtttccgttgaacatttattccttgcaatgtttaatgaaggcggaagctttataaaagatgaatttagaaaatataatgttacaaaagataacttcacaaagaacttgtctttggtgagaggagggagaacagtgaacaatcaaaatcctgaaaacacatataatgtacttgaaaaatatggttccgacttggtggaacttgcaaaacaaaataaacttgaccctgtaatcggcagggacgatgaaataagaaatgtaataagaatactatcaagaaagacaaagaataaccctgttttaataggtgaacctggtgttggtaaaacagcaatcgcagaaggtcttgctcttagaattgtaagaggagatgttccaaacaacctaaaagacagaagtattttctctcttgatatgggtgctcttgttgcaggtgcaaaattcagaggtgaatttgaagaaagaatcaaagccgtacttgatgaaatcaagaaaagcgaaggtaaaattattctattcattgatgaacttcatacgatagtaggcgcaggtaagactgacggtgcaatggatgccggcaacctattaaaaccacttcttgcaagaggggaattacactgtataggtgcaactactttaaatgaatatagagaatacatcgaaaaagatgctgcactagaaagaagatttcaacctgttatggtaggagaaccaagtgttgaagatacagttgcaatccttagaggtcttaaggaaagatatgaaatatatcacggcgtaaaaatcacagaccaagctcttgtttctgcagcaattttatcaaacagatatattacagacagattcttacctgataaagcaattgacttaatcgatgaagcctgcgctttaatcaagactgaaatggattcaatgccaacagagcttgatgaagtaaacagaaagattatgcaatatcaaattgaagcaacagctcttaaaaaagaaaaagacgaacttgcaaagaaacgtcttgaagaaatcaacaaggaaatcgctgaactttctgataagtttaatgccatgaaagcaaaatggatgaaagaaaaagacacaatcggaaaagctcaaagattaagagaagaaatagacagggtaaacagcgaaatagaacaagctcaaagagtaaacaatcttaataaagcagccgaacttaaatatggtaaattgccagaacttcaaaaggaattaaaagccgaagaagaaaaatcaaaagaaaaacattctactcttttaagagataaagttacggaagaagaaattgcaaagattgtttcaaaatggactcatatccccgtatccaaacttgttgaaagcgaaaaagaaaaacttcttcacttagaagatacacttcacaagagagtgatcggtcaagacgaagcggtaagacttgtaagcgatgcgataatcaggtcaagagcaggtattcaagacccatcaaaaccaataggttcattcttattccttggtccaacaggggtaggtaaaacagagcttgcaaaaactcttgcttataccttgtttgacaatgaacaaaacattatacgtatcgatatgagtgaatacatggaaaaattcagtgtgtctagacttataggtgcacctccgggatatgtaggatatgatgaagggggacaacttacggaagcagtaagaagaagtccttacagtgtagtacttttcgatgaaattgaaaaagctcatcccgatgtatttaacatcttacttcaaatccttgatgacggaagagttacggattctcagggaagaactatcgactttaaaaatacaatcattatcttaacatctaaccttggaagtgaatacttgcttgaaagtacagaaaaatacggcgatattacagaagaaacaaaagataatatagataaacttcttaaatcacattttagacctgaatttttaaacagactagatgaaatagttatttataaaccacttaagaaagaagaaatatctaagattgttgatcttatgcttgaaaaacttaaaaacagacttgaagataaattcttgcatttggttataagcgataaagcaaaggcatttataatcgacaatggttatgacccaatatttggtgcaagacctcttaagagatttattcaaagtcatgttgaaacactaatagctaaagcaattttagcaaataactttgaaagcggaacaacattaaaggtagatgtggaagatgataaattggttgtaagatattaataaaaggaccttaattggtccttttattttttttgtttataaagtaaaatatgattagaagcatacgataagttttattttaagttataaagaggtaggggaaatgaaaatattaaaaaaacttattatatttattattcctattttacttattgccggatattttacatttaaaaatataaattcagattggactaaaaagtttagtaatgagtttgatattttctttggtaaaggtaattgggaaagcgtatcagaagaaacaaaggaaagtataatatatgatgaatatattatcgttcattctgctccgtacttgtcggaaaatgttcccggtaaattccaagaatggaatataacctatatgaatgctgataataaaagagaaatggcaataatctcagaccatacctatagaataaataacgataaatattcttttctcagtaaaaaacgatattcaaaaaaacaagctcttacattagaatttatgaatatttccttttctatttgcggggataaagttatgaaagagagcatatcgccttatttaagcgaaaaagaaatggaggctttaaccgtagagatatcttatcacggaggaaatccaaagcccgaattttatgatgatttgataaagcaggcttggtttaacgtaaaagatataagtgctaaagattatctaaattatgataaacatgagttttatatttatatacgttcttacgattataaattggataaattgactgacgaagaaaaacgacacatttttgacagcatggaaaaaatagagaaagatttacttgaaaaatatgggaaaaatgcttcatttgaaatatatatagacgaaaatcacaaagtagaatataaagatggggtaaaaactgtaaattaacatgaattctcaccctctgtactttataaaaagcataaaaaatatcataatgagattaaagtatgggatagaaaaggagaattaacatgaatcaatctcagattggtaaatttataaaaagtttaagagaagaaaagaatttaactcaagagcagcttgccgagaaattaaatgtcagcaataaatctgtttcaagatgggaaaacggaaaaacaatgccggatttatctttacttgttatgatttgtgaagaattcgatataacaataagtgagcttttaaacggaagaagaatgagcatagaagaactaaaagaattaaaggatactgtggaaaggcttattaattattctatggaagaacagtcatttaaagcaaaaaaagtaaacagatttttaattttaggaattttgtttactattcttgcaattttaaataattatattccttatttagattttatttttagggaaaacatagcccaatttgtaagcggactgttttatgggcttggaacttcttttgaacttgtgggtttgtataacagttcaaatagaatatctttaaaagaaagaaaaaaagcattaaaaaaagataagtaaaacttatctttttttgtattcttttcttgctttgttaaagattattatagagcttattacgtctaaaataaaaattaaatgcattatgatatgtattgtcgcttctttgtttgataaaatattttcttttttcatttttagaacagcttttattccgtatgaagaggataccataatgagtatataattcatacatgcgagaataagacaaataatcggagaggccaaaagcaaagccggaacgaccattgccattataaatatcattcccacaataaacatagtgacaaaaaaaggaatatgtataagttttattgtcatattccaaaatgcaagagtgtaaaagtcgttttcctccttaagcatataagcatttattatgtttgccgcatatacgataaccgtgaatatgagatattgaaaaagaatgaaaagtctggtgtcttcatccggtaaagcaaacattaaaagaagcatataaggccaacaaattaacaataacggtaaaataattctttttttcattttattaattccctctagtttcttttatatattataaaggatttttattcaagagtatataaaaaacacaaagataaattttatctttgtgtttaacctataccaaagaatttatcaaaaaattcttttagattttcaataaccttttgttttttctcttttcgtttgtttccctctttagaaaatcttgatacaggaggcattattttgtcaatgtccgttcctgttgtttttatatatccgtctctaaacgcattttgaataaactttttagtgtcttcttcttttaagttttcttctttaattattttatcaagttctttttctttttctttctttataaaatttctccactcttcgtctatattgtctgtttcattgactctttcaataaagttttcaattagaacttttttacttcttaattcataacttgcatcaactgcgttttgtatattgattagtacttctttgtctttgcagtgactttcatgatattttttcacaagcattaatatataatcaatatttatatctacttgctttataagttctatttcaaatataacatcattggttatatcttctttttccatatcttttttatttatccattcatctctaatatcttgatatcttccggtgtagttttgtatgtctcttatggatattatgtcattttcttcaaattcatcaaaggagtttaaaagatttctcattctaagtatagagccaaaaagcattataaattctttttgtctttcttcccctgttattctttcttcacttaacgggaatttctcttttaatttatttattaggtcgatataaccgggtttgttttctcccttttcgtttgtatagccataaaaatagtctttgaattttcttattaatacaattcctcctgcgtctttatcgccaaataatgcaagagcatcatctacttctttttgaagatttctaaaacaaactatattcccaaatgttttaattgaatttaaaattctgttggttctgctgaatgcttgaatcaagccatgcatttttaaatttttatctacccataatgtattaagagtagttgcgtcaaaccctgttaaaaacatatttactacaataagcaaatcaatttccttatttttcattctaagggatacatctttataataattttggaatttatcgcttgttgtatcataggaagtgttaaacattttgttatagtctcttattgcatcttccaaaaattctctgctgtttgtatctaaagcggaagtatcttcgctgttttcttctcctaaaattccatctgcttcttcttcattttggctataactgtaaataagagcgatttttaattgcttatttctattttcattcatttgttttttaaactcgctgtaataagcctttgccatttcaacgcttgctactgcaaaaatggaattaaaaccgcttaatctttgtttttgttttatttcttcaatcttcttatctttatttgtggcaacttgttcaatattttttagggaattaaaaacataggttttgtttcccctatatgtcttttggtcaaagtggtctaagatatattttgtaataagtgagattctttcttttgccatatatacattttctctgtctatgtcgtatacctgcttatctttgatattatcttcatagtccattgtcttgttgtattctactctaaaaggcagaacatttctgtcgtttatggcatctactattgtgtatgtatgaagtaaatccccgaatgtttgagctgtcgttaaattgctgccactatttattcctttcgcatttacggcaaaaataggagttcccgtaaaaccgaataaataatatttcttaaagttttttactattgctttgtgcatttcgccgaattgacttctatggcactcatcaaaaattaatacaatttgtttatcatatatatcatgtttctcgtttttctttacgaaagttgaaagcttttgtattgtcgttattataattcttgcattatcgtcttcaagctgttttgtcaatacggcagttgaagtgttgctgtttgcacatcctttttcaaacctgtcgtattctttcattgtctgataatccaaatctttacggtctacgacaaatataactttatctataaaatctaaattagaggctattctcgcagttttaaaggaagtaagggtttttccgcttcctgttgtatgccaaatatatccacctgatgcaatacttccgtattttttatagttgtttgcaatttgtattctgtttattattctttccgttgccgtgatttgataaggtctcattaccataagcatattttctgatgtaaatatgcagtattttgcaattatgttaagaattgtatgttttgcaaagaatgtttttgcaaagtctattaaatcgggaattattttattgtttgcatctgcccaaaagctggtaaattcaaaactattgctggttttatttttgtttgaattttttgttgtggcttcttttatggcattatatctggtggagttggaataatattttgtatttactccgtttgaaataacaaatatttgaacatattcaaaaagaccgtctcccgcaaagaaagaatctctttgatagcggttaatttgattaaaggcttcttttatgtttattccccttctttttagttcaatatgaataagaggaagtccgtttacgagaattgtaacatcgtatctgttatcgtagtttgccccttcttcttttgtcacttcgtattgatttaaaacctgcaaatgattgttatgaatattgtttttatctaaaagagagatgttttttgatgtgttgtcgtctctttttaatacttggatatagtcttcttgtatcttccttgtcttttcaactatatgttcatttttatttgctatggaatctttataaaatctttcccattccatattgctgaattcatagttgtttaatttttcaagctgttttcttaaattaagtttaagttcatcttgtgtatgtatatctacatattcataaccttgagatattagcagatttataaattctttttcaagttctgcttcgctttgatatgcttttgcagtttgtattcccggtttatattctgttattacggtgttttcggttgttgatgcaactatgttaaagtagctcatgttttcacctcttttttattttgaaagttccttaaaatcaagcagtttatctctataatattcatattgtttctgtcttttttctatttcagcaggaagaccatttgttatatcattacaaagggtatcaaaacggtcaattatgtctactattctttgttgtttttctttttcaggtataggtatatttaatgttacaagacctttttgtgttaaatgtggtacggttgaaccagttttaactctttcaataaaatctttaaaatattttgaagtaaaaaaataatatatatatttaggtattatatttttttctagaattttaattctaaatacaccactatttaatgttgttaacttcttaggttctttgcttaaaaatgctacttttccaagagtaccatcctttgtaattagtatgtcatttttatgaacttggatattagaatccatgtcatatctatttttagtaacatacatacaagtatcaaaatttattgtaccatctgattgaaagtctgttcctgtaattaaataataatctccttctagtaaatattctgcttttgtcaatctttgccaaccaactctagcttttacaagggctatatcagtaatatgctttatttcacaattttgtaagttattgaaaatttgttgcttataatactcatactgtttttttcttgctgtaagctctgctgtaagctctgctgtaagctctgctgtaagctctgtaaaggtatccaaaatacgcacgatctcttcttgtacgggaagaggggggattgggattttgaagttttgtatactagatgtatatacatgaggaacgccacttcctttttttgtattaaaaattttattttgcatattttttaatacataaaaaataaattttgttaaaataatatttttattttttgaaactactgtgaatgcatcagagacaaaaataggagtttcccaaaaagctacatatcctgcattaacaccacttcctgctatagtaatattttcacctgttctattatgtttattacaataatatgcgggttttaaacctcctgcaatgacagggatattacctaagataagattcttttttgttatcgaattacctcttttcatttcagcaatgttctttaactccacatactcaaccccatcgggacagagttcatttatcagttgttctaatttgctcatatgttttcaccgttttctttaagcattttgtttatttgtttatcaaaatcagattctattttttgtgtcttgttgaattggtcgtattccaaataggctttttcctttgcatccttacttgatattttgcctttatcttttaatatttcatatcttctgaattccaaaaatgcatttatgctttttgcaaattcttccattgtaaatgtgttttctctctcgattaggtcttcaatataatcaaaatatccgcttactgctctttcgagacttttaatttgtttctcatccaaataattttttgcaactgttacgtctgattttaatattcttccagcaggagcatttttccatgttgtaagccccatatgttctttgttatgatctgattttgtatatactatttctgctgctgtttgacctgttattgcaaaatgaaatttattttgcaccatagcataaaatctttttgtaatatctgaatttttgtcataatcaatactgcattctgcaaaaatatctgttatttgctgccatattcttctttcgctcgctcttatagaacgaactctttccagcaattctttaaaataatctttgccaaataaggttttgccttgttttagtctttcatcatccattgcaaaacctttaatcatatattcttttaatatttttgtcgcccaaattctaaaatttgttgcacgaagagaatttacacggtagcctactgaaatgattgcatcaagattataaaagtttgttatatgagtttgtgttttatcttcaatggcaccatgcttagtggttgttgcaaattctgcaacaaccatggattgttttaattctccttcttcaaaaatattttttaaatgtcggcttattgttgatttatctacgtcaaacagttcagccattgctttttgtgtaagccaaattgtttcatcttttataaaagcatttacttttatattttcttcttctattttatacattaaaaattcaaattgatttttcatgttatccctcaatctccttgattattttgtcgatttcggctcttaaaatttcttctttttctactatctcttttatttctttgtttaatacatcaatatctattacttcccttgtatcttgtggttcaacatatgtatttacagataagttgtaatcttcttcttttatcttttcatattccacaagagaagaaaaatgttcttcttcttttctttctttaaatactgatagtattttatccatgttttcttttgtgagtttattgttgtttgttacctttatgcattctttgctcgcatcaataaacaaagtcttgttatcggttttgttctttttcattaccataatgcacgttgctattgatgttccaaagaataggttttccggaagctggataatagtatctataaagttattatcaataagatattttcttatttttttctctgctccccctctgtacattatccccgggaagcatactatggcagctgttccgtttgtggcaagccagcttaatgaatgcataataaaagcaaggtctgcttttcctttaggtgccaaaactccggcaggggaaaatcttgggtcgtttattaaggttgcgttgctgtctccttcccattttattgaataaggaggatttgatacaataagctcaaaaggttcatcatcccagtgctttggttttgttaaagtatcttcacaggctatatcgaatttgtcatagtctatatcgtgaagaaacatatttatacggcataagttataggttgttatatttatttcctgaccgtaaaaaccgtttcttacattttcttttccaagtactttaacggattttaaaagaagcgaacctgaaccgcaggcagggtcgtatactttgtttacttcttttttccctactgttccaagaagcgtaagaagagtcgaaacatctgccggtgtgaagaactcgcctcccgattttcctgcatttgatgcatacattgtcataagatattcataagcatcaccaaaggtatctatatcgtgattttgaacattatcaagtttcatgttgtttatgccgtctaaaagtttaacgagtctttcgtttctctttttaaccgttgaaccaagcttgttgctgtttacgtcaaaatcatcaaacagtcccgcaaaagaattttctgaatcggttccttttgccgaattttcaatatttctaaacactttttctaatgtttcgtttaaattttcatcgctttttgccttattttgcacattgcagaaaagttcgcttggaagaataaaaaagccttttgaatttactatatcttctcttattgtttctgcttgttcatcttctaatttggcatagtcaaattcaaggtcaccggcgtctctttctcctttgtttatatattctgatatattttctgatatatatctataaaacattgtgccaaggacataatttttaaagtcccagccgtcaactgctcctcttaattcatcggctatagcccatatagctctatgaagctcatctctttccatttctttcttattgtctgccataatttttatcctttgttatatatttaattttattttacataatttttaaacccatttcaattttattggatattttgtagaaataagaattttgttagggaaatttttccttataaaacttataataaataaatcaaatcttttaatgtatattataataaataaaaaaacaggagataaaaatgaacgaatgggaaaaagcacaaagaggaatgctttacgatgcaaattataataaagaaattttaaagcttagagaaaaatgtgcagatttgtgttttgaatttaataatctaaaaccatcggataaagaaaatcaaaataaacttttaaaggatattttaggtcatataaaagggatagtaacagtaacacagcctttttactgtgattacggttttaatatatctattggagaaaatttctattcaaatcataacttaactgttcttgatgcggcaaaagttacaataggagataatgtgtttattggaccaaactgtgtcataacaacggcttctcatcccaaaaataaggaagaaagaagaagagggcttgaatttgcaaagcctataaaaatcggaaatgatgtttggataggttctaacgtcgttattctaccgggaattactatagaagacggggcgataattggagcgggaagcgttgtaacaaaagatgttttaaaagacagcgtggtttatggaattaaaggagagattaaaagataagggtttatttagggggatttattataagttattaaattcttaagaaaaagttaattgtaatataaaataaaaaaattataataaaaataaaatattacaataaattaagggaaatagatgaaaacaaaatataagtataatcctcctttttcttatagcttacatgatatgtatgttaataatattaaaattattgatagtaacataaaacttgaatttgaaaatggatatgtaaaacttgttgaaccgtacaacgtaataccgggcagtattattattgaaaatgtagattttgatttttcaagtgtggttattcaaaacagtcttggtgaatatggaatgttcaaaagtgaaaaattagaaattggagagtttatcaaaaaatatgatgattttagttttgaaattgtagatgaactttacgggtataataaattattctattcaggttatttaaggcgtaaacataaagatgaaatttatgccatggatttatatgtttattttatcggtgatattatttatgaaacagaagaataaaataacccctttgaatatattattcaaaggagttttttgtgtttttataagcatgatgattatagataactttattagtcttatattattgcaacatgatttgattttttagaatatgaaaatataactttttaattatttaaatatcttcatcaatcctctttacacaaaaccaagaacctttcgtatcaatgagtcctgatttttttaatttgccaatttctgccgacatagcacttctttctacccccaaataatctgcgagagcctgcctgtcaaaaggtattgtaaattcacagctgttgttttgttttgcttgatctaaaagatacagcattagcttgttctttgttgtcttttctgacatatatcttatttttttatttaatgatagtgttttttgtgccatctcttttaataaatttttgattactaaattatgataatgacaggaagcggaacacattgtcattactttatttgaattaagtaacattatcttactgtctttatcggctaccacgcttacgggaaaagaattaagtcccgcaaaagaaaatacttccgcaaacatctctgactcttttaatattgttaaaacgcttctatttccataatagtcatctcttataattttaacttttcccataagtacgattccaaaattttgagccaggtctccttcaaaaaatatattttcattcttttttacatttataattttcccattaagacattttatcattgattttaattgattttcttgaacacctttaaataaaggacattttaataatatatcaaaatatttttccataaacttctccttttgttggaaatacaacattttcttaggcttgattatagtattatacatttacaaaatcaaataaaaaataaatattctaagtgaataagtaaaaatatttaagaaaagctaatatggaggaaagttatgaatacaaaaataaaaaatataaaccaagcacaagtagttttattaaaagatgaaatatcttatcaaaaaggtcaggttgtaagtaaaacccttgctcaaaatagtgcattaagcattacattattttcattcgataaaggggaagaaataagtacacataaatctggcggtgatgcttttgttacttgtcttgacggagtaggtaagatcactattgatgataaagaatatattctaaaagaaggtgaatctattgtaatgcctgctaatcaccctcatgcggtatatggtgaagaagcatttaaaatgctgcttgttgttgtattttaagaaaggagtttttaatatgaaagcatttgttgatgaagaactttgtattggatgtggactatgttgcacatactgtgatgaagtttttcgtttaaatgaggatgggaagtcagaagcttataaagatgtaaatgaaaataatttaattaaggtacaagaggcgattgataattgtcctgtatctgcaattagtatggaggaataaaaaaatatggaaaataaaatgttttgttatcaatgtcaggaaactgcaggatgcaaaggctgtactgccgtaggtgtttgcggtaaaaaaccaaatgttgcaaatatgcaggatttattaatatatgtaactaaaggattatcttttgttacaacacgtcttagacaagaaggtaaaaaagtatctgacgatataaattatcttgtatctataaatttatttacaacaattacaaacgcaaattttgatatagaaagtattaaagacagaattactttaacattaaagacaaaagaagatttaataaataaattagataataaagaaaatctaccaaaagctgcactatggaatggagaaggagactgggaagaacttgcaaagactgtaggtgtgttatctacaaaagacgaagatatccgttcgttaagagagcttataacttatggattaaaagggctttgtgcatattctaaacatgcaaatgcactattaaagacagatgaagaggtagatagatttattcaagaagcgttatccctaactttagatgatagcttaagtgttgatgatttagtaaaattaactttaaaaaccggagaatacggagtaaaaggtatggctcttttagatgaagcaaataccactgcttacggaaatcctgaaattacaaaggtaaatataggagtaggaaaaaatccggggattttagtttcaggtcacgatttaagagatatggaaatgttactacagcagactcaaggaagcggtgttgatgtatatactcattctgaaatgttgccggcaaactattatccaaaattaaagaaatatcctaactttgtaggaaactatggtaatgcatggtggaaacaaaaagaagaatttgagtcattcaacggacctattttaatgacaacaaactgtattgttcctccaaaggatagttataaagatagagtttatactacaggtgcagcaggttacccagggtgtaaacatattaaaggagaaataggacagacaaaagatttttcacagattattgaacatgcaaaaaaatgcagtgctccgacacaaatagaaacaggagaaattgtaggcggttttgctcataatcaagtatttaagttagccgataagatagttgaggctgtaaaaagcggagctattaaaaaatttgtcgtaatggcagggtgtgacggtagaatgaaaagccgtgaatattatacggaatttgcaaaagctcttccaaaagatacggttattcttactgccggatgtgcaaaatatagatataataaattgaatttaggcgatataaacggtatacccagagtgttagatgcaggtcagtgtaacgattcatattctcttgcagtaattgcaatgaaacttaaggaaatctttggcttagatgatattaatgaccttcctattgtttataatattgcatggtatgaacaaaaagctgttatagttttacttgctttattatctttaggcgttaaaaatattcatcttggacctacacttcctgcattccttagccctaatgttactaaagttttagtcgatgaatttaaaatagcaggaattggaagcgtagaagatgatattaaattattttttaattaaataaaacagcctaataaggctgttttttattttgataaatgtttgttaatacaatgattattttctcttttttaaattctcaattatcaaaacttaacaatatattaacaatttatgatattgataaaaacgaattattattttgttataataccttaaatattattagtgattgtacttaaaaaaggagaaagtacttatggattttataattgaaattatatgtgaattatttttatgtgtaatatcagttatttttgaagataaaaaagtaagtaaatgggttaggtatccttttattggtataattttcatattatatacttttattattggagtacttatttgggcagggataattggtttacaaaaggatataataaagcctgttgtattctttggattatctgcaattttactgcttagcggaataatgagcataagacgaatttgtgagaaaaaagatgatttttaatccataaagatattaataaaaaacctcttagtatttaatactaagaggttaattttctttattatggcaccccctgcgagaatcgaactcacaactaacccttaggaggggtttgttatatccatttaactaagggggcgctttaggtaaaaaaccattatatataatagcatattataagttacttatcaaataaaacaatccttatttttaaaggctttttaaaatacaaataaattaaatgtaaacagttttataaaaaacactatgattttattttattttataatataatatatttatctataacaaagaaaagaggtttttatcatgaaaggaattaatgcatcgcctggagttgcgattggtaatgtattcttatatgtaaaggaagatttagttgtaacaccgggtaaaatcgaagcatcagcagttgatgcagaacttaaaaaattagatgacgctattgaaaaatcaagagccgaattacaagctttaaaagaaaaaacagttaaagaaatcggggaagaagaagctgaagtatttactgctcatatgatgttcttagatgaccctggatacattggtgaagcccaaaataaaattaaaaatgaattgatcgttgctgaacaagcattaaacgaagttacagaaggtttcgttgcaatattcggggctatggacgatgaatatatgaaagcaagagcaacagactgtcaagacgttgcagacagaattttaagacacttattaggtcttgaaagtgctgatttatcacaagttggtgaaaacggaattatcgtagccgttgacttaacaccatcagatacagctcaaatgaataaagataaagttatcggttttgctattgatgaaggaagtagaacttctcactcagctattatggcaagatcacttgaagttcctgctgttgtaggtcttggtaatattacaagtgaagttaaaggtggagaaaaaattatcgttgacggtacagacggtaacatcatcattaacccaacagatgaagaaattaaagaatatgaagctaaacaagaagcttacaaacaagaacaagctgaacttgctaaacttaaagatatgccaagtgaaacaagtgatggacacaaagttgaactttgtgcaaacatcggtagccctaatgaccttgaaggtgcaaacaaatacggtgctgacggtgtaggtctattcagatcagaattcttatacatggattcaaaagaaatgccatcagaagacgttcaatttgaagcttataaacaagttttagaaggaatgaacggcaaaccggtaatcatcagaacacttgatatcggtggtgacaaacaacttccatatcttccaatggaagaagaaatgaacccattcttaggtgttagagctgtaagactttgcttccaaaacgttgatatgttcaaaactcaacttagagctttacttagagcaagtgtatacggaaacgctcatatcatgttccctatgatttctaacgtacaagaagttagaaaagctaaaggtatcttagaagaatgtaaagctgaacttaaagaaaaaggaatcgaatatgatgaaaacatcaaagttggtatcatgatcgaaatcccttctgctgctgttacagctgatattatcgctaaagaagttgacttcttctcaattggtacaaatgacttatgtcaatactcattagctgttgaccgtcaaaaccaaaacttatcagaacttaaccaaccactttcaccagcaatcatcagacttgttaaaaacgttattgatgcttctcataaagaaggtatcttcacaggtatgtgtggtgaaatggcaggggatccaacagctgcattattactattaggtcttggacttgatgaattctctatgtcagctccttctatcttaagagctaaaaaagttgtaagaagctttacatatgaacaagctaaagaaattgctaacgaagttttagaaaatgctgaaactcaagacgaagtaaaagctatcttagctaaatacttagactaattaaaaaaattaaaatgatagtgtaacctcataatatggggttacactttttttgtatcaattcattttttatcatttagtaactatttttatttttttatataaatagtcagtgttaataacatagatataaatatatttaattaaacttaaaatgtattgtatattaatatattttgtgagtttttatgtttatatttttactaatcattatatataatttgtattttttattcattgtaggctgttagatttatgtagtatagattattaaatagttaatagaaaatttatatttattcttttatttatgataaagtgtatctttaattaatatttatgcaacatatagaattaaaatatattgaacaaaaaaaataaacatgttagaattattccatatctataattaaaataggtcgtaaaaaataaagacaatattctaggaggaaattccatgatacaattaaaagtacctcataaattttttgtgctatttatgtcattggcattggtaatagggttatttatttgtcctatgccggtaatggctttaagtgaaggaaatgtaattgatatgtcagatacaaatcctgctgcatcaggagatggttggacatatgcagatggagtttatacaatatccaatggcgcaaatgtaacagttgttggtgataatggaggaagtggtcgtaggattttaatcgaagccggtgctactgcaacagttacattgtctggaaccagtattactcaaacaaattcaaatgctgcacctataggattagataataatactaatcttacattgatacttgcagaaggtacagaaaatactttatcaggagcgagtacacaagcttcaggtattcaaatggggcttgctggtcaagcaacggttacatcgactttaacaattgaaggtacaggtacattatatgctacaggtggtaatcgttggcctggaattggaggtcgtgccggaggaaaaagaactatcaatataatgagtggaacaattattgctcaaggtgctaatcaaggtgctggaattggaaatggtagaagtacacctgcaaattcaaacttcgttaatatatatggtggagatattactgctataggaggtaataatgctgccggaattggtggaggagataacgttggaaaagatgacaatgcaggcgtaattactgtatatggcggtttgattaaagcccaaggtggaaataatggagccggcattggaagtgggtattataattattctggtggaactctaaaacttgatggaaatggtattatatttgcttctagcgtaagtgatggtggatcatataataaaacatctggggttttatttcaaggaaattccggaactgtttatggcaatgttattttagaaaatgactttgaagttgagagtggaaaacagcttactgttcctgcaaatacttcgttgacaattgctaagggaattacaatgaccggtaatggtaatattcaaaataacggaagcataaaggttaatcttggcggtacttataacggagaaaaacctgccggacaggctcttttatatcaaattgtatcaaatatagatacggatatatgtagtttaagtcctcaagtacctgattatatacaacaagataataatcttgctttttctcttaatattaatgatggattctcaaaaacagataattttgcagtaaaagcaaatggagaagctcttattgagcaagataatcaatatactgtttctgtaacgaaacctatagaaattactgttgaaggtgtggaagatattacatatcctgttattaatggggtaactaatggagaaacttattacactacacaaagtgttagtgtttttgatgcaaatctaaaatctgttacattaaataatgcctctgttcaagaaagttttgtcttagatggaaatacagatacaacatataatattgttgctacagataaagccggtaacatcacaacatgtacggttactatgaagtcaattgcaagcattgctgatccaattaaagatattacagttgataatgtaacttctgatgataaaacaactattgaagaaataaaaacaattatagaaaatataaatactgacaatgctactgaagaagaaaaagcagaattaaatgatatattaaataaatgtgaaactttgattgagaaaattgaaactgttacagattataatattatatcaggaaataacagtcagtggactaaaggtgatagtagttcaatcagtattacagttaatggtgatgttgaaaaatttgtaggaattgaaattgatggaaaagctgttgatgaaaaaaattatacagtaaaatctggaagtactatcattacattaaaaccggaatatctaaatacactatcagttggaaagcatactttaactgtaatttatacagatggtgaagtaactggtgaatttgaaatattagataaaaataaaataattacaccagaaacgggagatgataacaatattggattatggactatactatctattattgccggttgtggattagttggagctgtgagtttcaaaagtaaaaagaaatatataaaataaataaaaaaaagcaccttttaaatatgataaaaggtgctttttatttaacaagtttacatcccttttaaattaaaggaatgatatattaatatttctttaaaagtaaatttgattgatatatatattttagtataaatgatattatgataatttattatatgtatttaaccatataaaaaaatttatatctgttatttttatgtgttaaaatataatcaaataaagtatgaataagaggataaaacattgaacgatacaatggcgaaaaatataaaaaccagactttcaaacaaaaaaggaagcgaacaaataaaatttgtattagaaggggttcttattgggttagttgcagggataagcgctataatttatagatttcttttaacaaaagccgaagcttttttgtttggtaccataaaaacaataaatggtaattttttgtatatgttcttttggggagtatttataatactactttctttaattattggtaagttaattaagtttgaaccaatggcgaacggcagcggtattcctcaagtaagtggagaaatgaaaggatatttatcccaaaatccaattaaggtattaattgcaaaaataataggaggaactctttgtattgtatcgggattttctcttggaagagaaggtccttccatacagcttggagccatgtctgcaaaacttcttgcaagaattcaaaaaaaagggaaaactaaagaaaaagtttatctttcatgtggtgcaggcgcaggtcttgctgctgcatttaatgctcctttggcaggggctatgtttacaatggaagaaatacataaaaattttgacggaagaattattgtaagtgtaatgacagcatctattacggcagattttcttgcaaaaagtatcttcgggctttctcctgtatttcactacacaaatcttcaaacaatcccattaaaatattttggtcttataattattctaggggttatacttggagtatgcggtagtatatataataaggttatggtctattctcagcatatatatgctaagctaaataaaataaaaaccgaatataaaatactaattcctactgtgtttgcatttattcttgcatttactcttccagatgtacttgcagggggaaatcaaatggtaaaaatacttgaaaataatcagtatattttatcaacacttattactttgcttattgtaaaatttattttttctgccatttgttttggctctggagctcccggagggattttctttcctttgcttgttttaggttcttttataggtgctatttttgctgtagtttgcacaaatctaattggtatttctgcggattttacgcaaaagtttataattcttgcaatggcgggatttttctgtgcaaccgtaagagcaccttttactggtataatattaatagcggaaatgacaggctctctttctcatatgatatcaataagccttgtctgcataatatcttatgtggttgcttatatatttaaaagtgagcctatatatgaaagcttacttgataatatattaaaaaaacaaaaaatagaacttaaagagccaagcaatgaaacaatgttagtaacatataatatagcttttgaaagcgaagttgatgggagaagacttgatgaaattgagtggcctaaaaattgtcttcttgttgcaatagaaagaggaaataaagagtttattccaagagggtataatactattaaggcaggggattttataacagtgcttataaatgaaaacgaaatgaattatatgaatgaaatgttaacgcagatgtgttgtgaaaaagagaaaaagtatattgattaatgttaagaggtaatatatggaaactcactgtcttttatccagaatgaatataggaacattaaaaaaattaagaggaaaattgctttttgttaatgtttatgtaagtgacaatgaatataaatggacgaatggagaaatagaagaaaaaagccaaaaattatttgatatatttgattatttaaagaaatgtataaatgaagaaaatgtattttttgaatattacgtttcatcttattatttaaatatatcatatccttttgaaagaacaagctgtgaaaagtggttaaaagattttgcaaatggatttgattgccttaatttgaaaaatgtgcatgataagatgtatttaaaatacgacgtggaccaggtggcatttttatttattactaagagaccatctctatgttatgccataagtgcaaaagagtctttttatgatttttgtgagtttgcagtattatatggtgaaaattataattctgtaattcatgaaattctacatttgtttggagctgctgatttatattttcctaaagaaatttcagatgttgcaaaagaaatgtttcccaaaagtataatgtttaattcaacttataataaaatagatgattttacaaagtatgtagtgggtattcatgaaaaaccttcttctttggcaaaaacctttatagatagaacaaaggatataaactgtgaatatattgaaaattctataaaagggcagtggcaagacgggtttagaagagttacatatgcaggaggcatggtatacgaaggtaattttaaaaatggtatgcgtgaaggagaggggaaagtattttatacaaatggagcagtatatgaaggagaatttaagaataataatatagaaggttttggtaaaatgcattttgcgaacggtgcattgtatgagggggaatttaaaaataataaaagaagcggaattggcaaacttatatatccaaataaggtaatatatgaaggagagtttaaggataatgaatataatggtcagggtaaactcacttatccaagcggtaaaacatacgaaggggaatttaaaaacggtaaaatagtaaaaaataaaagataaggttttgccttatcttttttgtaataataaaaaattcttgatttataaatgtaatgtttaatatttataatattttaacatagtttcgtaagaaatttttaataattaaatatttgcctttagggtattattataataaaatacttttagtatagaaaacagaagagaggtaacggaatgtcacaagtaattatccttgatcaccctattattaaagattatgtatcaactttaagagatgaaaaaacaaacataaaagattttagggaaacagtaaaaaagttatctttatttatcggttatgaagcagtaagaaatgttgaaacaaagaaagaaaaaataaaaactcccctttgtgaaacaacgggtgaaaagattataaatgataatataacggttataccaatacttagagcaggacttggaatgatggatggaatgcttgaacttcttccaaatgctaaagtaggtcatataggacttgaaagaaacgagagaactctaaaagcagaagaatattattttaaaatgccaaataattacgaaactatggacgcttatgttgttgacccaatgcttgcaaccggcggttctgcagttgatgccattgataaattaaaagaaagaggaattaaacatattaaatttttatgtataatatcttctcctgaaggaatagaaaaacttcaaaaagaacatcctgatgttgatatatatactgctgtaatagatgaatgtttaaatgaacatggttatattcttcctggacttggagatgcgggagatagaatttttggtacgatataaaaaaacgcacttttgtgcgttttttaattttcaccgtatttaagttcttttccctctttagaatatttttttctttttcctgttatttcatctatatttatttttattacatttgttctttctaaacttctgtttattgcatcatcaaacatttccatattgctttttgcatatctaaggcatattaattttaatgcatgtatcttttcttctttttcctttacttcctctgcttttccatataaaactgcactttcaaattccattgtaaactcttcaggttttggtctgcaccttgatacagcgcatatgcagatttgattgttgtttttaagtaagtctatcttttttccttccattgcacagtgaaagtataaatgattttcttcaagtacaatgcttattggtatacagtatggattgttgttttcatcggttaatgataaaactacatatggtgactttttcaaaacgtcaagggcaaaatttttatccatttctctgtcttttcttctcatattaaacctcttttattttaaaaattgaagattatcttctatattcattcccattcttttgtctacaacgattttctcatctttttccatagcttttcttacaaaatccgaagcagctttgcatgattcttttagtgtaagtccttttaggaattttgtgattaaaaccgctgagaatacatctccagttcccgggaagcgtacgtttatataatcataaggaatagaaaaatattcgtcttcaaagtgtgagtatccttctatataataattattgtcatctttatgttgtacacttgtgataacaacagattttgaacctatttttctaaattcgtctatatactcttttatttcttctttggttaaagctgtatttttcatttcatcatataatataaaagatgcttccgttaaatttggtgttactatatctgccatagagcacatttttctcatgttttttacgacattttcgctaagtcccaaatataacttgccgtcatcacccataatagggtcaaccattactattggagatttttctttgttgtcttttattattttttctattaattcaacctgaggatctgagttaataaatcctgtgcaaatacaatcgaatttaaaatttaatttattccatatatcaattgtcttttccatgtagtctgtcatatccattatttcaaacaaaccataatcaagagtgtttgatactattgctgttggtaagttatgcactctaaatccaagggaagaaactatcggcatcattgcggataatgcaactttgccaactcccggcaggtcgtttataagtaagatatctttgtctttgtccattttctttctcctgataaataatatattgctaacattataatactcaaaaggagaaatttaaaggataaattatattgattattttattttaataaaaaaagagcatatgctcttttatttgtttactttatttaatgctttttgtttgcttggagttatatatacatttaatttttttaacttgttgtgaaattctcttaagttatcaaaaatataatttattgttactttctttccgttctttttatatattacaaacttgttgttataaggtctgtaaatggctgcaatttcatctttttttactgtttttgtagggagcacaccgcttgaaaatgttattgtatcttcacttatggatacttttgaaaggaaggcttttaaaatatttattgttccaattacaaatactaatgcaataaaaaatatttcaagcccttcaactgttcttcctgctttttttgctatgctgaaagtattaaatatagataaaattccaagaacgtatattataagtccaaaagttacataaacttttttgtttttcttttccattttaaaagtattcattttctcacctctgtcaggtaattatcatatcataaatttttaaattcttaaagagaattattagatttatgattgttgtaatattaaatattttaatagatttttgggtatcataatactttcctatgcgaaataaatatccctaaaaaaacttacgaacgaaataaaacgaaagtaaatagcataaaaaacaagctaaataaacgctttcaatttactttttattttgttttggttataatttatttaaagataacataaagaaggttaaaaaagttatgtataagaataaaaggcaatatgcgattttggaatatatatacgaaaaaaaagaagctacggttaatgaactttcaaaaaagtttaatgtttccaaggtgactataagaaaagatttgatagaacttgagtcaaaaggaaaaataaagaaaaatcatggcggagcaataccggcggaaaatataatgctaaatgaaatgccttactacaaaaagaatatgacggcaataaacgaaaagagaaaaatcgggcaacttgcgtcaaaattaattcaagacaaacaaattgtgattatagacaatggttcaacaacaaatgaaattgcatctttcttaaatgataaagaaatagttgttgttaccaatgatataagaattgccaataaattatgcggatatccgagtatgaatattgtaatatgcggaggttatataaaaacgccgggatatgctgtttttggagctatggcagaagatttgtttaaacatactttggcagatatatgtttcttatccgttgatagtttagatataaatacaggactttcgtataactttttggattcaatcgcaataaaaaaacaaatgattagaaattcaaataaagtaattgttctttgtgacagttctaaaattggaaagcagtcttttgcaaaactttgtgatgtagataaaatagacgttttaattaccgacagtatggatataaaacttaaaagacgctttgaagaaaaaggtgtaagagttttaatagcaaaataaaaggaaaggaggggaaagaaacatgagcgtaaaaatagttgttgcctgtggaagcggtattgctacttcaactgttgttgaacaaaaacttaaagatattgtaagcgataataatctagatgttaattttacaaaaacatcaataagttctttagaaggaattatagatgattttgaccttgcagtagtaaccagtaaatttaatatagaaaattcaaaaactgaagtgctttctgcaacatcgcttcttacaggaataggcgaagatgaatttgtggaaaaatttgttaataaagtaaaaaatttatagtaacgtttttattaattaaaggaggaaaaaaatggatacattattggtagtagtaaaatatgtaactgattctcttggaacaatggttgttatgcctttattccttatacttttagggcttgcctttagaatgaaattatctaaggctttacgttcaggtttacttgttggtatcggatttcaaggtattaatcttataataactcttctttcaaatgccgtatctcccgctgcaacggctttggcagaaaaggtaggacttaattttaatattattgacgtaggtttcccaacaattggtacagcagcatgggcaactccgatagctgctcttgttattccaattgcaattttaattaatgtcattatgcttagtttaaaatttacaaaaactctaaatatcgatatatggaatatgttccactttattcttgcaggaggaatcgcatatttagtttcaggcagtgttgttgttggtcttatagtttctgcgatattctctataataactcttttgcttgcagattgggattccaaaacatggcaggagtattttggacttgaaggaaccagttgtactactcttgcaataatgacaagtgcaatttgttcttttattgtgaataaagttatagacttaataccaaaagtaagagattttgatattaatcccgcaaaaataaataaattaaagggaataagcgatcctatgtttttaggttttgtaattggtatcgtaataagtttaataggaggacttcctgttgctcaaattcttaatacaggtgttggaattgcagctgcaatggttcttcttccaagaatggtatctcttcttatggaaggactagctccaatatcttctgcagcatcagcatttacaaagaaaagatttaaaggaagatctctattaattggtatggattgtgctcttggtataggagatcctacagttattgcagcatcaacaattatgattccttttgcaattttacttgcagttcttcttcctggaaacggatttttacctatagtttctttaacaggtcttacatatttttgtgttcccgctgcggcttattctaaaggaaatttattcagaacaataattacaatgctaatattctatactttgcatatatatgttataaatgcaataagtccgctaattaccgaacttgtacactgggcaggtgttgcacttcctgaaggagcttctcttgttgcaggcggaaatccagaacatgcattattattaatcattaaacctattctttctctatttgggcttgctaattaaggaggtatattatggtagaggtacttcttgtttctaataagaataaagatgatgttgataaaataattgatattatctataatttaggaaatgagttttttattgaaagcaacgtaacagtggttgaaagtgaaaatgctgataatatcaattttgattatgattttgcagtaaccttaaatgataaaattcatttaagtaaaaagacaattgatgctacttcaattattcgtgatatatcagcggaaaaaacgaaaaaggatatacaaaaccaacttttaaaagcaaaagcaactcataaaaggttaagagaaagcgggaatgaaatatgaaatatgatattatcatagaaaatggtacgataattgatcctttgagaaatatagagaaaaaggaagatatttatataataaaggataagatcgtaaataagccaagtaaagatgaaagtgtttcatataagcagaagatagatgcaagtggatgttatgtaatgccgggacttgtagaaaatcatactcatattttttacggcggaggagatgtaaacttaaatcccgatgtaataatgcttccaagcggtgtaacttcagcgatagatcaaggttcttccggatggtctacgtttgaatctttttatagaaatgtcatattaacttccatgatgaacataaagtgttatcttaatgtttcaaatacagggcttataaccgaggattattttgaaaatatagatccaaagtattttaatgaagagatgataaaatattataccgataaatataaagatactataatcggtcttaaaataagaatggataatggttctgtaagggggcttggtcttaagcctttggaaaaagcagttgaaattgcagataaattgaaattacctttgtctgtgcatgttaaaaatttacctaacataactgaaattgcaaatatcttaagaaaagatgatatatggattcacatatatcagcaaaaagggcagactctttttaatgaaaaaggtgaaattcataaagaaattcttgaggcaaaagaaagaggcgttttattcgatgttgcaagcggaagaggaagtttttcatttgatatgattaacaaaagcttaaaacaaggatttaaaccggacttattaggtaccgatcttgtgacgtataacgtatatgaacgtcctatattctctcttccttatacaatgtcaatgtatttaaatcttggtttttctcttatggagcttgctaaaatgtgtatacaaagacctgctgaaatgatgcatttagaggatatatctacgttaaaagaaaatactgtagcagatatatgcattataaaaataaaagaaaaagattttatattcagtgataaatacggcggtaagcttaacgcagacagattaatcattccattgcttactttaaaagacggtaaagttttatatagaaatattgaattttaaaacggcagtatctgccgtttttttaaattaatcaatcattaataaaattttaagcatggattaaaatttcttgtgctaaaatataaaaagacaaggagaaaagatatgcctaaaatattaatagttgaagatgataataaattaaggaatgaacttggtttatatttaagtaataacggctatgacgttgatgagataactgattataaaaacagtgtagatgtaataattaacagtgactctgatttggttttactggatataaatttacctatgattgacggagagtatatctgtaaggaagtaaggaaaacatcggatattccaataataatgcttacgagcagaacatcggaaatggacgagcttatatgtataaattatggggcagatgattatattacaaaaccctataatccaagaatactaattgctagaatagaagcactgttaaaaagagcaaataaaaatgtaagtgatactatttcttatatgggagttagggtaaatctatcaaaaagcacatttacttataatgacaaagagtttgatttaagtaaaaatgaacttaaaattctacattttttgataaaaaataagtctaaaattgtatccagggattctcttatggattacctttgggataataatgcttttgtagatgataatacattaacagtgaatataaatagactcagaagaaaacttgaaagcgcagggcttggacattttatagaaactaaaagggggcagggttatataatatcatgaagttaaaagattatttaaaagatagatcatttagcataggtttatttgtgtttttatttttcttaacggctttctttctttttatatttaaagtaagtgtaatactaaaaattaatatattaatatttttgataattataccttctatttcttttatgatagattatcaaaaaaagaaaagattttataatagtttatatagaaacttaaagaagcttgataagaagtatcttataaacgaacttattggcagtgcggattttcttgaaggagagatattaaatgatgttttgtataccgtagataaatccatgtcagaaaatgttaatgagtttaaaagaaaaaacgaagatttagaagattatatagagctttggtgtcatgaaataaaaactccaatcgcaacatcttctatgataatcgaaaataacagaaatgatgtaacggaaagtatagaagaggaaattggtaagatagataaccttgtggaacaagtgctttattatgcgagaagtaagcatgttgaaaaggattatgtaataaagaaagttaatcttgaagatattgtaaaaaaagctgtaataagaaataaaaaagacttcattcaaaagagaataagccttaaaataaaagatcttaatgtttatgtgaattctgacagtaagtggttagaatttataatcaatcaaattatactaaacagtataaaatattctaaaaaagaaaaggcaaaaatatggatatataccataaagaaaaaagatagtatacaattatacatagaggataacggaataggtataaaaagaagcgatcttccaaaagtattcgataaaggatttacaggtgaaaacggcagaaaggtatataaatcaaccggcatgggactttatatatgcaaaaccttatgcgacagcttatatcataaaatagaaattctttcacaggaaaatgcaaagactgccgttattattacttttcctctaagttcttatgtaaatatgaatgattaaaagtagtatattactccttttttatatgtattaatcatatggaatattacataaaaattttacaaacaataattgtaaattaattattttcttgttgattttttccgtattttaatgtatattatttactaataaaagggagtagctggcacgtatagtgtgtatgatgtcgccaatctcgatagatactaaatctatccgtatcataatgaaacagcgagacttttattgtatattaaagtacaataaaagtctcttttttattgtacggtatgattatgaaaggaaagaaaagtatgggtaattattacaatcaggattttaatgatgtaagaaaagaaattaatggtacaaccgaaggcttaagcagtgaacaagctaaaaaaaatcaagaaaaatacggctacaacgaattaagcgaaggtaaaaagaaaactgttttacaaattttccttgaacaatacaaggatttccttgttattattcttattgcttctgcaataatatcgatgtttctaggagaagttgagagtgcggcagtaattttggttgttattacaatcaatgcaattttaggaactgttcaaacaataaaggcagagcagtctttaaacagtttgaaacagctttcatcgccaaacgcaaaggtaatgagagatggtattgtaattgaaataccaagcagagaagttaccataggagatgaagttcatcttgaagcaggggattttataccggctgacggtagaataatcgaatgttcaagtttgaaagttgatgaaagtgctctaacaggtgaaagcttggcagttgaaaaaacagaggaaactttagaaggtgaacttcctttgggagatagaagaaatatggtttattccggaagttttgtaacttacggaagagcgagctttgttgtaacgggtattgcaatggataccgaagtaggtaaaattgcaagtatgcttaaaaatactcaggaaaagaaaacacctcttcaagtaaaccttgataaatttggacaaaaactttcaattgcaattcttgtattatgtgctcttttatttgggcttcaagtagtacaaggaggaaatgttacagatgcattcttatttgcggtagctcttgccgttgctgcaattcctgaggcattaagctctattgtaactatagttcttgcttttggtacacaaaaaatggcaaaagaaggtgctattattcgtaaacttcaagccgttgaaggtttaggtagtgtatctataatttgttctgataaaacaggtactttaacacaaaataaaatgactgttgaaaactattatgtaaatgaaaaagatataacttcagataagatagatatacatgataattcacagtcaagtcttcttttatacagcattctttgtaatgactctacaaatattgacggaaatgaaattggagacccaacagaaacagctcttattaacttaggtgaaaagtatggttatagtgctcttaatttaagaaataaatatcaaagattaagtgaaattccttttgatagtgatcgtaaacttatgtctactctaaataatattaaagatacttacgttatgataacaaaaggtgccattgatgttattttagacagagctacacacatagtaaaagatggtaataccgtagaaattactgatgaagataaagaaaaaatagaaaaacaaaatatggaatactcaagaaacggtttaagggttcttgcggtatgttataaaaattttgatgaagaaaaagcattggaacttgaagatgaaaacgggcttactttccttggtcttatttcaatgatggacccaccaagggaagaaagtaaagcagcagttgaagaatgtatcaaagcaggtatcaaacctattatgattacaggagaccataaggtaacagcttctgcaatcgctaagagaattggtattttaaaagatgaaagtgaagcttgtgaaggcagtgtaatagaaaacatgagcgatgaagaacttaaagacttcgtagaaaacataagcgtgtatgccagagtttctcctgaacataaaataagaatcgttagagcttggcaggaaaaaggcaatatagtttctatgactggggatggcgtaaatgatgcaccagcattaaaacaagctgatgtaggggttgcaatgggtataacaggtacagaagtatcaaaagatgcatcatctatggttttaacagatgataactttgcaacaatcgtaaaagcagttgaaaacggaagaaacgtttataataatataaaaagagcaatacaattccttatttcaggaaactttgcggcaatccttgttgttctttttgcttctttggcagctcttcctgttccatttgctccggtacacctactattcataaatctattaacagattctctacctgcaattgcacttggtcttgaacctcataatcctgatgttatgaacatgcctccaagaccaaaagatgaatctattatgaataagaaattcttaacaagtgtaggaacagaaggttttgttataggagttatgactgttatagcattctatatcggatatcaagacggaaatgcacttcttgcaagtacaatggcgtttgcaacactttgtttatctagacttgttcatggatataactgtaaagcaatgaagccggtactttttacaaagagattttttaacaataaatatatgcaaggagctttccttataggttttgttcttttaaatgcagtattattaatacctgctatgcaagggttattctcagttcaaactcttaatatgagccaattatttacagtatatggtcttgcattattaaacttacctataattcagttattaaagagaataagaaattgtaaataataaaaaatcctatggttatccataggatttttttttattcaaaataaaataattcttcaaattttttatcaagggcaattgctaaaatcaaagcgagttttgcagtaggattaaattgtccggtttcgattgaacttattgtctgtcttgatactcctaccatttttgcaaggtcgctttgagataatcctttttctgctcttgcgatttttaatctgttttttaatactaattcttcgttcatattaattttaccaataaagtttttcttaattataacatattttatcattcataataatttgctttttattttttataatgaataatatatttaatttgtttatataatcattgtaaaatgctcaacaagattttttataagaaagataacacatattatcataattataatagaagatttttctttagtttttatatatttataaatatattctccaaggcaacctgcccaaaacatagacatgataccgcttatatctatatcatgaatagtatcaaatataattataataacacctacaatcattaacattaataaatttgcattttgtgcatatgagcttatttgtttttctctttcatctctaacattattttcttttctgcttttttctagtatttcatttttatccattttatttccctcaaatatatttattatggctttaatatatcactttatgtatataatgtcaagtatacttgtcaaaatatctataaaacttgtcataagcttttaataaaaaacagaggcttaacctctgtttataataatctttgtatgatttttgcttcttttaatatttcgtcataatcgtatttttcttttacatcatcaatagacttttcttttaacttattatcttcatagtatttatatattacatcataaatagttactacattatcttcataagaagcatttatttctttttgccaaccatttatatcaaggttatttagcattatgcaaagttgtgcacctatagagtataaagattgttcacttacgtaagtagccggtatttcatctttgctcatttttgtaaaggtattataaaatgcagtttctttttcttcgttgtcttctccaaagaagataaggttgtaaggagtttcagttaaccttgctgctcttatggcaacgtaaaaagcacttccttcgtaagttattttttctctttcgtctttaatatatgtttcgtttaatttttctctttctttttccaccgtaacatattcacttattaaagtattgagtttatttatgcttacattgtctttgttgcattcttttcttatattgtccattattttgtattcaacacctatataagaaagttcttttgccgtaagacctacacttgccggattatcatatttaggccagtctttttgaatgtagtagttaaaggcttgtttagtaaacattgctgaaaaagcttcatttgggtattcttcgttattaaaactttttgaattgtatttaaaataaaatacattttggcttttggcaatatttaattcatcattttttgatgaataattactgtttagagctgataaataatcttctacatcattgaatctataaacactatcaaaatagaaaccttctggcatgcttactttttttacgttttcatcttcaattccatttatgttaatggcaaaataggaaacatctttgtttgatttgtttcctttgtcgtcattttcgtcttttctgacaagaagtaaaggtctttgttttaaatcaagatcctgccatataacagcttttgatttatataaaactttatttagttcgcttaacatttttttatcggtattgtcaagttcactatatttgatcgttttgctgaatgattgatagtttttgtttttgcaccctgtaatacttaagcaaagtaaaatacaagttagcaaaacaaatattctaattataccttttttcaattccatccctccaatatatatatttataccacataaaaagcaaaaagtcattttttttgtaatttcaaagagtaaaaagtcgtattttgtacgtttataatgtaatgattacataaaaaatgttcatataattttatttttgttaagttttaagtgtagttatatatgtcatatttttgacaaaaatataaataagctctcaaacgtaaaatttatgtaaagtgaatgtaaaaaaagagaatactctatatacatttaatttacaaaaatttacaataaatatgcttaatttatacgaaaattttacaataaaattaaagggagaaaaagtatgacaatagcaaatattataagtttactcggcgggcttgctttgttcctgtatggtatgcaaatgatgagcggaggacttgaaacggcagccggcgataaaatgaagagtatactggaaaaacttacatcaaacagaattataggcgtaatagtgggtatgctgattaccgcagtcattcaatcatccagtgcgactaccgttatggttgtgggatttgtaaatgcgggaatgatgtctcttagacaagctgtatggattattatgggggcaaatatcggtacaacaataaccggacaattaattgctcttgatataggtgctatagctcctgttattgctttccttggggttgtaatgatagttttcattaaaaatccaaaatcacactgtattggtgaaataattgccggacttggtgttttattcatcggtatggaaatgatgagtagtgcaatgatgcctttaagagaatctgaagctttcattagcttaatgacaaaattctctaatcctatatttggtataatggcaggtgctgtatttactgctgttattcagtcatcaagtgcatcagttggtatccttcaagctcttgctttaaacggacttataggtttagacggggctgtttatgtactatttggacaaaatataggtacttgtataaccgctgttcttgcttcaatcggaacaaacagagaagcaaaacaaacaaccgttattcatttgacgttcaatattatcggtactataatttttaccgtgatttgtatgtttactccgttaacatcttttataagttctctcacaccgacaaatcctgcagcacaaatagcaaatatgcatacattgtttaatattgtaacaacgttgctgttattaccgtttggtacataccttgcatcgtttgcggaaaaagtattgcctgtcaaagataaagaagaaacggaagatgtttttgaaagtcctcttccaactctttcatatcaaataggtacatctgcaatactcgttgaacagatagaaaacgaaataaaaaacattcaaaatatggcttttaagaatgtaaatgaaagtctttcacaattggtaaattttgacaaacaaaaagaaaaagatttattaagaagcgaagataaagtaaatacaatcaacttaaaactttcggaatatattaccgaagctctcggtattgagcaaaacagtgaaaacagctttaaaatgagtgtttattatcatcttttgatagatatagagagaatttcaaattacgctgtaagaatacagaaatatcaggaaaaagtaactttaaacagcgaagaaaaagacagaataggacaacttcaaaatcttatatttatggcatcaaaagatttggaaaatcttgaaaaagaagaagagcagtatgaaagaatcaaagctttttgtaaagaaacaaagagacgtcaaacagtcagaatgaaagagaaaagtatttctttcgaacttactttgtttttctctcaacttataaacgatgttgaaagaataagcgaacatatgcttgccattgcgagagattataatatgatcgaattgcataaagcataagttttactttgaaaaataaaaaacctgtgattatcacaggttttttagtacaatttaataaaatgtgggtttatcaatttcatttaatattttttttaggtttaccgcaaacaatatgcatgttgtcgttattgctattatatctgctataggttctgccaagaatactgctttaagattattttccattaatgccggcattatataaattaaggggataagtaatattatttttctgaatattgcaaggaaagttgatatttttgcctttccaaaggcgataaaagtctgctgacatgcaacctgtgcgcccatgaacaaaagagccgccatgtatattttaatagcccataatgagagttgttcaagatttgggtctgaagtaaaaatatttataagtattttagggcaaaattgtgaaactgcccaaagtaaagtcgaataacaaagacaacttaaaagaattaacttaaatcctttctttattctttctttgtttcttgctccgtagttatagcttattataggttgtcctccctgggtaataccttgaagaggtaacattgcaaattgcattatgcttgataaaattgtcattgcacctacagccaagtcccctccgtatttaagaagtgaagaattaaaacaaagaacaagtacgctttctgtgctttgcattatgaaaggagctactcccagtgcaacagatggtaaaataatatttttatttaatttaaagttttccttttttaattttaatattgtattatttcccgttataaacttaaatgcaaataatgcacttaatgcttgagatattacagttgcggttgcagcaccttctacacccatattcaaaccaaaaataaaaatagggtcaagaataatatttgttactgcgccgattaaaaccgtaagcatgcttatttttgagaaaccctgtgctgatataaaagcgttaagcccaagagtaagttgaacaaatattgttcctatggcatatattgttatatagtttgatgcgtatgttatggtatttttgcttgctccaaaaaggtaaagaagcggggttttgaatataagcataattagggttaaaataactgatactattactagtgaactaaaacagttacctaatattttttcagctgtttcattgtcttttcttcccataaatatgcttgctcttggagagcctccaactccaaataaataagcaaaagcggaaacgatcattataagagggaaacataccccaactcccgttaaagccgttgctccaacctctgggatatgccctatgtacattctgtctaccatgttatataaagcatttactatttgagatataatagcaggtaaagccaaaatcataagcaatctgccaactggttctttcccaagatcaacttctttagacatttttatcttcatagttttttgccctttcttcaaagatgtttaatattttttttattgttttttccatttggtttatttcttcaatggaaatttcttttaaaataatcttgtccatttcgtcttttgcgtttaaaatttgttttattatttcatctgatttttttgaaagaattattcgctgaattcttttatcctcatcgtctggtttgatttttattaaatccttttttaaaagtgaatctatgcttctgcaaacaagcccttttgatacattaagatatttacataattcttttgatgtgtttttagtaggattattgtttaaaaaaatcaagacgtttatttcatttggagaaaaagagtcatcctctaacatgttagtgaatgattttgcgtaaacttttcttatatttgcaaaatgctttaatactttttctatattcgttaaatacataaatattcccccttattagtttacttgtaaactaattgattattattttatcactattgttttttttgtcaatataaaagacatttttattatgtaaatatatgcttgtaaaaaggtttttaattgttgtaaaatattcatgaaaaaaatagtagaatttatattttataatagtttgatagtaatcgggtagagggttttatatgttaaataaaattttattgaaaattaaaagtgaatttatactttttgtatcttttatagttgctttaatatcggttttttttgttccaatttcaaaagattatgtttcttatattgattttaaagtgcttgcggttttattttcactaatgattgtaatagacggacttcaaaagcatggattttttacttcttttgctcaaaggatattatacggaaaaaaacgtcttagattattatatttaattcttgttttgcttccatttataagctctatgtttataacaaacgatgtagctcttataacgtttgttcctttttgtgttttaatacttaaaatgataaataaacaagagtatttaatatggaccatagtaaatcaaactattgcagctaatcttggaagtatggcaactcctataggaaatcctcaaaatctatatttatacggtaaattttccttgagttttggagggcttgtttctattatttatccttatgtgctacttagtttaatatattttttactaagctgtctatatataaaagatgaagtaataagtgtaaaatttgataaatactttacttttgacataaagcagactgctatttttataatgttgtttttaatatgtcttttatcagtttttaatatattggattataagatacttttggttattattgttttagccatactgatatttgataaaaagcttttaagatatgcagactattcactgattttaacatttgtatgtttttttgtatttgcagggaatataagcagaattcctcaaattaatgattttatatctttacttatggaaaaaaatgctcttattacttcgataattacaagtcagataataagtaatgtaccatcagcacttttgctttctgtatttacaaataattaccatgctttaattttagggtgtaatattggaggtcttggaacgttaattgcttctcttgcaagtttgatttcctttaagatatatttaaaatcagaaaaagtggaagcaaagaaatatattataacatttactattcttaatgttattttacttgttttatttacaataattgcacttgttttatgatataattattaatcttatataaaaaaagaataaataatgttatatttattctttttatttattaaaaagtggaactttttagtaaattagtttataataatttaaaaatttacataggagtcatgtatggataatataattgattcaataataatgtttatagataatttggcgcttccaatatccttaaatacgatattatcaaatcatattatacctattataagtaatgttttggttatgggatttatatggattgtagcaagtatattcttatatttttatacaagagataaaagagtttctattttaatcattatcgggcttttcctttgctctatagtgggcaatgaagttatgaaacctgttttatttcattttagagaatttttaagtacaaacggtgttggaatatatctgcctgaaattggaagatatacttttccttctggatatataatgatgtgcgcaagcagtaccgttttgatttattatactaataaacagtttggtttatatgcactttgtattaccggcttggttgcatttttaagactttatataatcacaacttatccagttgatttctttataggtcttgggcttggaataatgataggagcattccttgttttattcttaatgaaaaagaaaaaagagtatgaagaaattgaagatttaagtgataaatttcacttttaaattatgtaaaaaaaaaattaaaaaaatataaaaatagtattgacaagatatatatggttatactataatatatcgtgctgacgcggggtggagcagttggcagctcgtcgggctcataacccggaggtcgcaggttcaagtcctgtccccgcaaccaaaaagtaaatatggcgggatagctcagttggctagagcacacggttcatacccgtggtgtcgtaggttcaaatcctattcccgctaccatatatatggccccttggtcaagcggttaagacgtcgccctttcacggcgaaaacaggagttcgattctcctaggggtcaccaatttgagatataactaccgtaacggtagtttttttatttatatagtttaataatagggtgtatgtaaatagtaagtttagaagtttttattttatacaaaattttttattttttctaatctccattctatataagtatgactattaaaataaaaagtatagtatagactttaatcataaatttgagaaaaaaataagaatagtaaagatatatgaaagttttaaataaaatactttggtattaaaaagcatccttaaaggatgcttttaatttttattatttttcgtttttaacttgtcttctgattctaataccgtttgcgattgcacatgctaagctgacaactgagaaaattgcgattgcgccaaatcctctgaaccattctgaaattttaacaagtataaagttaagaggtgttgaagcatttgaaatacaactaaccaagctgaagccttccggaagttgataagatgcacttattgcagcttgtgtaaataccggtgcaattgcggttgaaagaagtacaccgattgccatcattgatattgcaataagtaaacttctaaatgcattttcgttacacattggaacaattaatgccattatgtaaggtgcagagcttaggtctgtaaaaggcaagaattgatttccaggtacgattaatgcaagtaaaataattacaggagttaagattagtgctgttgctatggttgtaggattaccaagggccactgcggcatccataccgatatatattttacttctatttttgaattttttgtttattataacttgtgctctttctgaaattggtgttaatgcttcaccaaagtattttgccattgcaggaattaaaacaagtgtagctccaagagttatggcaattaataaatatttatcgtatgcttttattccataagcaaggatacctatgataagtccgattacaaatcctacaattaaaggatctccaagtaccccaagtttttcttccatcttctttgcattgatgtctattttgttaagtccaggaattttatcgataattttatcaactacaaaagaaatacttgcaaggactaccgtcattgtatgagggaaacttattccttccattttagtaactcttgctattctctctgccgttaagtccgcaagaactaaggcaattacaaactcacatactgcggcaagaagtcctagaggaactgatgatgtcacaattgcaaccagcgaacctgtaaaagcaagctgccagaaattccaaatatcaatgtccgctgtttgtgttaagttaagtacaagcataacaacatttacaagcaagcatacaggtattattatcgctcctacctgtgttgaaaatgcaatttgagcagcagtcggccagccaacatcaagtatatttagatttaaatttagattttcaaccatttgttgtgctgccggaccgatagtgttaccaagtagattgattacaaggtttattcctataaatgcaacccctatggtaagtcctgattttaaggctttgccaaagcctgtgccgatacaaagggcaataacgaaaatgataataggcatcataacgcttgcgcccaagtttgataagatatcaaaaaaacctacaatataatccatgatgtatcctccctaaaacgtaataacttaaataaattatataactttttttatatacagtcaaagaaaacataattatttttatttatagttatttgataattgtcattacttttttagtgatgatttttatatggataaataatcttttatatattgtagtaaaaggataaaatttatttgtaaaatattaaatatatattaaaaaaatgctctttgcttgtgatttatctgtcaaaagattataatgaatttaaataaatattttgtctgagggggcaattatatggaatttagaaaatttaaagataagtatattataagacttaacaaaggagatgaagtaatatcttcaattaccgatttatgcagaaaagaaaatatcaaacttggtaactttgttggtcttggggcggcaaataaagtaagtataggactttatgatactgagcagaaagtttatcataggacttcatatgaagaagctatggaaattacttcacttatagggaatatttcaacttttgatgatgaagtatatcttcatgttcatataacactttgcaataaagatatgcaggtgtttggcggacacttaaatgaatgttatatttctgcaaccagtgaaattactttaaatataattgaaggaaaagttgaaagagaatatgatgaagatacgggacttaatttatataaatttttataatcataaaggagtacattgtactcctttatgatttttggtcatcgtaaatttctgcaaaatatccattatatccacatttactgcatgtaagttttctggttttgggtgtatgttttgaaaatataaatgtttttaatgcaggtttaaatatatgttgacattttgaacatatatatgctgaatttttataatatatattggttatgaaaatgccgagaagcaatactataaacattccaagaataaaaggaacccaaattccttttgtaattcccaaaattaaagtgaacaattcgattatatccattacaattccgacaaccagcatttttttgtgagtgttttttatattttttgtattattcatgattttttctatgtcatttatagaattgacgggtattgtatttttattttttatactgtcttttattaagtttattgtttctatcttattttttagttctttttcttcgtttttcagatatttaagttgttcgttcataatcataataattaaagcttctttttctttgtcctctagtatttcttttatttttgaaagagacagtccgatacttttaaaaagacatataaggtttaatgtttttatatcttgttcattatataatcttcttcctccttcgctaaaagaagaaggtttcaaaatgtttttcgtgtcataatattgaacagttctgatagaaacaccgcatatttttgcgatttccccggtagtgtatgttgacatagatatcacctccttattgtcatattacaatattaccttgcgttacaagcaagcatttttaataaatattttaattaattcaaaaaagaatgataaggatgcatcctttaccattctttttatggtcataattgtttaaaataatcgtttccttaataatacatatatctagtccgatatatattttctgtttgcttttgggttatttaatcagcccgttttttataaggaaatcatgagcgacatcgctcgatttttttccttctacatcgacttggtaatttaattctatcattacatcttcatttaaatattttcccagttcttttaatatattttcgatttgaggatatttttctttaagttctttgcttattacgggaactgcatcatatcttaaaaacgcacctttatcatcttcaagtaccacgagatcgtatttttttaataagccatcggtggagtatgcatctattacatcacaatctttgttttggagtgcagtatatctcggagaaccgtctattggtgttacttctttaaagttcatattataagtgttgttcaatgctttatagcagtcttttctttccatgaaagaaagagtcggtgataatacaaggttacttgatactttctccaagtcgctgtatgtttttaaattgtatttttctgcggtatctcttcttacagctaaagtatacgtattgttaaagttaagttcatccaatacttccaatccgtaatttgatttcatttcttttttgcatacattcaatatttctttggtgtcttttgtatcattgtgaccgagcacgctgccgtaaatggttccggtataatcgatatacatgtctatgtctccgttttttattgcatccaaaactataccgctggctcccaaggaaagagattgctctacttgtatgtccgttctgtcttcaataaggtcttttatcatataggatagtatttcctgttccgtaaaatccattgaacctattttaatggtttccgcagtactgttttttattgtaaaaaaacttcccgtaatcaatgctaaacatgtaatgattattataaaattatcaaaatatttctttattttactttgtggatttgaaagttttaagtttttaggtattaatttcctttccagtatggagaataaataatctatgaataatgcaagcagacatgccggtatggcacctgataatatttgtgcgttgtttacggttcttattcccgcatatacgaaatatcccagtcctcccgctccgataaatgcggcaagggtcataagtcctacggcgcttacggcacttattctaacacctgccaatataaccggaagagccaaaggcaattcaaccttataaagaacttggaactttgtaagacctattccttttgctgcttccaaagtatccggatttacattttcgattccggcatatgtattttttactatcggaagtaaagaatataatattaccattataattgcgggttttgttcctattcctacaaaagggattaaaaagcccaaaagagccattgatggaattgcctgtataatatttgtaattcccattatcggtttttttgccggttttacataggatatgaggatgcctaaaggtacgcctatgataattgatgcaattatagccaaaaacgtaagttctatatgttcggtaaataaatcaaatatggtcgaagcgtttgaagaaaaataatctataaaagctttcatttattcgtcatcctcgctttcgtcatatttttgttttagtgttgtaaaaagaatacttttggtaatgagtcccacaagtttgttgtcttcgtttacaacggggatggtataagtgttggtttcgtctgttttctctagtacatctaaaatagattcttccggagacacatatgtaaaatttagatgatatttttctttgtgtctttttaatacttgccctaccgttaaatttttgtttctttcttttaatgctcttctggcatccaacagtccgagaaattctctttttttgtttattactattatgctgtctatctttttatctgccattattgctccggctttaaagcattgtaaattatcataacatgtaaccggattatccatcataatatcttttgcccttataagttccggagattcccatattcgtttttttcctataaaattatgtacaaaatcatttgccggatgttttaatatttcttccggcgtatcatattgttgtatgcttccttcgtttataatacatattctgtcagcaagttttattgcttcggaaatatcatgagttacaaaaacgatggtattttttactttttcttgtatttccaaaagttcatcttgcagatttgttctcgttatggggtccaatgcgctaaaaggttcgtccattaaaataatatcggggtcatttgcgaatgctcttgctattcctattctttgttgttgacctccgctcatttgggaaggatataaatcaagataatcatctgctttgagtcctatcatttcaagaagttcatatgttttcttctttattttttctttatcctttttttgaagttttggtataagttctatgttttcttttaccgtcatatgagggaaaagtcccgtttgttggattacataaccgatttttcttctaagttctatatcgtttatgtttcttatgtcttctccgttaatgagtatttttccgttgctcggagttataagtttatttatcattttcagtattgttgttttaccgcatccgcttaatcctatgaggcaaacaaattctccgtcttttatctccaaagaaatattttttagtatttcttttttcttatagtgtttggagacattttcaaattgtatcatttattttcttcctttctgttacgtttgtgataaatgtaacttatataaaatattgtcgcactaaaatattaaaataagctttaaatccttgtttttttatatatttttaaaaataaattaaaagaatgcgtcatatctttttataaataaatatcccctttcatacatgaaaggggatagagttattgaaacattccaaaacttatggaaagaccttcgtttactttattcattgtgtccatatccacatgacctattttttctcttaatctttgtttgtctatagttcttatttgctcaagtaatattacgctgtctttattaagtaaatcatttttagccgaaagagagatatgagtgggaagttttgctttgctcattgacgatgtaattgcagaaacaataacggtagggctgtgtttgtttcccatatcattttgtataacaagaacaggtcttaaacctccttgttcgcttcccactatagggcttaaatctgcgtaatatatatctcctctttttatgttcatttgttttactccagtttatttatatattcttttgttttaattctttatcctcatatttataatatttaaaagaatcaaactatgttactaataaaatctttgccgttaatgagattttttatacctaaaaataaaatttaaagtcatattttttatataaaaaaatatattttaaaaggagtatatttaggaggaataaaatggaatttgaacaaatggtaaaaaaaattaatttaaccggtaaggaagataatattgatatagttacagaagtttttgaaagcgtaaaaattcttgataatatgtcaaatatagaaagaattttgcttacaaacagcgatgcaatgataaaaaacatatccttaaagaatggtaagttcgttttaaagggaattttaagagttaatattttgtatcttggggaaaatgagagtctgtgcggtatagataaaaatatagaattctttgttacccttgcagaaggagaaaaatgggataagctttataatctaaaaactcagattcaaaatattgaatttagagtggtgaagaaaagaagaattgaagttagcgctaatgtaagagtatttggtatttgtatggcaggagaatatataaacacaataagcgaagagggaatgaaagcacttgaagttaaaacttgtcatgatacgttgagtatttttgataccaactctacaaaagaaacatttacttttaaaaaggatatacctttaagtgacagtataaatattatttttgtcagtgcagctttaagagatattaacactaatgcgtcgggggtgggcgtattatacagtgcaaaagttgaaatacttcttatatataaagacggttttgaagaagacagtgaggtaacgatagaaaaactggtttatcctataaatcatttcattgaaaaagaccctaaattgaaatgcgactattataatataatccctagcattgaaaacgtgaatgcaaggtatgtaatggaagatgaagattctttcatagaaattagtatggatatgatttcaaatactttgtttagtgaaaataaagaaatagacgttgttcttgacgcctatagtacgaataaatccataaagccggttttaaaagaacaaaatgtaatatccctaaaaagtgaaacggaaaaaaatataaaagtaagtaattcaaaaaccttaatggatatggatatgataggttctgttataggggacagtgaaaatattaggtacgagtattccatagatgaaaacatattaagcataaaaggcgaaatagaagtaaatatggttacatatatagataacgacagtaaatattatgttgataccataaatcttccttttgaaatgaaagaagaagtagatttttcaggtggagatgacttatttataaatattgatataaataatttagtcataaacagcttaaaccaaacaataagcattgatggtgatataaatatatgtgtttatgtacttggaagtatgaatgttatgaatttatatggagttgaacagatagaaaatgtagaagaaaaacaaaaagatataaaagtaaagatatattacaaagaaagaaacgagagtttatgggatataggaaagaaaaactttataaaatcagatgatatcttagatatgaatgatattgaaaatgaaagcgatatagaagacggttatcctcttattataaggtagttttatttacattcccttattatgttgttataatatgttttattacatataagggagaagacatttggaatacatgacaatatacgattatttaagtttttttataatatattcttttttaggctggtgcgttgaggttatatatcaaacctttaaagaaggtcgttttataaacagaggatttttgcatggacctgtttgtccgatttacggttttggtgttttattggtaatatattttttagagcctttaaaatcaaattttgttattttgttttttggttctttggtttttactacactgctggaactatgtacaggttttgtgcttgaaaaattatttgcaataagatggtgggactattcaaataacaagtttaatttaaacggatatatatgtttatctttttcgttaatttgggcgtttgcttgtgtgttcgttgtgaatattatccaccctcttataaacttgttcgttgatgttattccatataatgcaggcattattttaattatttttattttattaataatgcttgttgattgtattttaaccgttaatacaatattaaaattcaaggcaaaattagaaagactaagtcaaattggagaaaagcttacacagttatctgataatattggtaagaaactttccgacgaaacccttgaatttatggataaaggtgaaaaattaaaagaagatatgtatcttgagaagcttgctataaaagagcttaaagatgagaaaaaggatattatcgaaaatcatttgatgaaattcagatattatgaatatttcaaattccatccaaaagttaaatttcaaaaatacaatgatgtttttgaagagctacttgaaagaagaaaaaagagaaagcattaatgctttctttttttatattgaacataaaaaatttattttatataattatattaatataatttgctaaatggaaattaggagaaaaatatgtccgaaataaaattatttaaaataaacaatgaagttgaacgattggttcctacacaagttttacttgaaaaagaacttcagaatttaattgaaaataatatggaacagttttttggtgttcgttttttgtatagcgaatatagtataccaagtgggagaatggatagtattgggattgatgaaaataactgtccggtaatttttgaatataaaagaagcagtaacgaaaatgttattaatcaaggattgttttatttagattggctgcttgaccataaagcgaattttaaacttcttgttatggagaaattaggaagtgatgctgcagaattaatagactggtctgctccttgtgtaatttgtgttgcaaatgattttacaaaatatgatgtacatgcagttaatcaaatgcaaagaaatataaagttagtaaaatataaaaaatataatgatgaacttattttatttgaacacttaaatgctccgattataaaaaatagtgtagatagtacagtaaacgaagaaaagagaaattcatcacaaaaaactcatttagaaaaattaaataatttatcaaaagaattacatattttatatgattcaatttgtgattatattgaatctttaggggacgatattgtttctaatcaattaaaactttatttagcatataaaaaagttcaaaatatggcatgtattgaggtttataataaacaaattataatatatttaaaacttagccccgatacagttatattagaaaatggatttacaagagatatgagaaacgttggacattatggaacgggagatttgcaaattaccataaaaaacaataatgattttgagaaagcaaaacctttaatcgaaagagcatataatgaaatgtagaaaaatagccttgaataaaggttatttttttattaataaaagaacatcattttgaatacatttaagtaaagacttttttaaggagaatgatgtgaagttacagtgtctgcattttaataacagaaaaacttatagatacattactcattttgaaaatgagtattatttattttgtgaagatcccctatcttgtatatattctcttgttaaatatgataaagaaaaaagtactgcaagggatattcttctttttgaaaattattttgattataagattgatgattattgctgaacttaaaattagaggtgtagtatctgatgaagaaaatcctactactgtaagaggtaataaaccttttacggaaaatatatataactacggattaatataccaatcaattatatatcttttggcaaccattttaggactagcctttatatctattatgccaaataaaaagataccaacaattacatcaatagggcaaaaaacgttacaaatatacttttggcatatatttgttatgaacattttaacaaatatatttaatttagataatatattatgtacaagcccaaccggaaaactatgttatatgataattgcaattattactacatttattttatctttaaaaatattttcttttccaacttcactttttattaataaaaaataagagctattctctaatagagaatagctcttttattatttacccattttttgttgttgtctttttttattttcagctttaattctaagttgtttatcaagaatttcttttcttactcttaaatgatttggtgttacttctaaaagctcatcgtcatttataaattcaagatattgctctaaacttaattgtctgtgaggagtaagtcttaaagcttcatcacttcccgcagcacgcatatttgtaacttgttttctcttacatacatttacagtcatatcgtcaggtcttgagttttctcctacaaccattccttcataaacagtagtatttggtccgataaacaatgtacctctttcttgtgcattgtataaaccgtaagtaatactttctccaggttcactagcaattaaagaacctctgcttctgccttcaagatctcctttatatggcatatatttttcaaagtttgagtttacaacagcagtaccctttgtagctgtcataagttcacttctgtatccgattagtcctcttgaaggaatcataaattcaagtcttgtatatttatcacttgatttatccatatttaaaagttcaccttttcttgttgaacagctttctataactgttcctgtatattcatcatcaacatcaacaacaagtctttcaaaaggctcacataaaacgccgtctatttcttttgttataacagttggttttgataccataaattcataaccttctcttctcatattttctataagaattgaaagatgaagttctcctcttcctgatactttgtaagtatctgcactgtcagtaggttttacttctagagaaatatttgatagaagttctctgaataatctatttctaagatgtctgcttgttacatattttccgtccattccggctagtggtgaagtgtttacggaaaagttcattgaaagaacaggtttatctatttcaacaaaaggaacagcctctacattgtcaacagctccgattgtttctcctatgttaatatctgcaatacctgctatacatacgatttctccggcgcttgccttttgacaaggaacttttttaagtccttcataagtataaagttgagaaattttaccttttgtaacatttccttcttttcttgcaatacttaccatgtcatttgcttgaacatgacctctttcaattttaccgattgcaagtcttcctgtgtattcatcatattcaatgtttgatacaaggaattggaaaggcttttcttcatctcctgtaggacaaggaatattttcttttatagccttaaataatacttcaagattatcatctttttttacaggtgtttcacttgcccagccttgttttgcagaagcaaaaagaacttttgaatcaagatagctttcatcagcttcaagatctataaataattccaatacatcatcggcaattttttcaggtgttgaattttctctatctactttgtttataactattattacaggtaagttttgttccaatgcttttttaagaacaaatcttgtttgaggcatacaaccttcaaaagcatcagcaagaagaataactccatttacaagagaaagacttctttcaacttctcccccgaagtcagcatgtccaggtgtgtctacaatgttgattttaatatcatcatagtatactgatgtatttttagctaaaatagtaattcctctttctctttcaagatcatttgagtccattactctttcatttacatcttcattttctctgaatgtaccgctttgtttaagcattgcatctattaatgtagttttaccgtggtctacatgggcaattattgcaatatttcttatattttctttcttcattaattcatccttctaactttttttattttataaaatgtgcataagcacgctaatattcattaactaaaaaattatatcactatataaaatcaatgtcaattttaagcaccaataaatccttttataaccttaatatagcctcttttttaaaatttttgaataaaatcttataaaaaggcaataataaaaataaaatttattaattattaatttttttatcattttaatttaatatttattatttataatgacaatgtaaaatatagaaatataaaattaatgtttccaaattttatataatatatttttaccctttgaaattgatattgttttgttttagtgaaaaaacaccgcaaggtgtttttttctttttataaacaaatactataattaatcataaaaattaactttctaaatataatctattaggaggctttttatgattaatttaaacggtaaaaaaataaaaatgtttttttcttttttaattttcattatttttttaattacaatatttatcctatttttacataatatcaatgctggtattgataaaactcagtggggacttggaaattataaagaaaataaacaacctgtaggaaatgcagataaagaaacattagaaaaatataatgcgtactatgtgggagatgaaaatcaaaaagttatttatcttacatttgatgcaggttatgaaaatggatatacatctaaaatacttgacaccttaaaagaagaaaaagtccctgccgccttttttctggtaggtaattacatagaaaaaaatcccgatttggtaagaagaatgattaatgaaggtcatatagtaggaaatcatacatattcacacaaagatttaagatatgtaagtgacgaagaattcaaaaaacaacttacagatttggaagatttatacaaaaaaacaacaggtaaagaattaaaaaaatatttaaggcctccggaaggaacgttcaacgaacatactctttctcttgcaaacagcatgggatacaaaacaattttttggtcgttagcatatgttgactggaacaataacgaacaaaaaagtttcagcagtgtatttgaaaaaataatgcccagaatgcataacggttgtgtaatgcttttacattcaacatcaaaaacaaacagcttagttttaaaagatttaattacaacacttaaaaaggaaggatatacctttaaaagtttagatgatttaacaaaataaaataatatttttattttttctccacatactaaatacgtaaccaaaagttacgactttaaaatgtacaggaggaaaaacatgaataaaaatacttcaatcgaatgcgatgttaaaagctgtgaatataattgtaatgactgtaactattgttcccttgattcaatcaaggtaggtacacacgaatcacatccaacacaatgtgactgtactgattgtctttcatttaaattaaaagccaaataggaaaccctccctaattatattacctctcaaacttaatattatatgatataaaaaatttatatcatacaaaaaaggaagaatgcttattcttccttttttaattaatgtttatttttattgttcgtcaacatctataatattatcattttggttatcttgattatattggttgtattgattatattgattattataatttgtttgaccataaggattagattgtatcatatttatagcattcattaatttcaatacattcttttcttttgtatttcccataatcataaaccaatctattatagtccagataccacatccaccagctgtaagaagtttcaatacaccaagtccaacttcaccaagcatcattctatcaacaccaagacctccaacgaataaagaaacaaccaacattacaacaggtgatttaaactgcattgttgataattgcacaaaacattcatcaggaagcgcttgcaatctttctcttattaacatcatattttcttcaggaaaatattcagcatttgacattaaaaacatatctactttattttgttccataattttctcctctcattctacatgtatatcgtaatttaagtatataatggttaaaggttttatgtcaataaaaacctttattatttagtttttcttaagaaatggaaaaggatagtttgactaaaaaaattttttatattatattaaaataaaaacagaaagtatattaaattatattatctatgaaaaagaaaaatatcaaaaaatacattttaattttaacagtaacagccttatatgcttttattataaatataacaaaaataaactgtcttatacgatacattataggacttccttgccctttttgcgggacaacaagagcgttaatttcttttttgaatggtaatataaaacaagctttttattatcatcctttgtttatattatctattccctttttaattttacttattacttctaacgaaaagtatttttttaaaatgaatagaaaaaccagaacttgcattctttcttttattgctattttatatattgctatatatattataagaatgatatttttttatattccttaataaaatattacaaatattaagaattaattaactttatgtttttttgatgtttataagaaaatattgtgatataataataaaaaattttattacatacttttcaaatagggaataaaagagagtcttacatttttgtaagactctcttttttttcacaaaaaaaggctgtgattaaaaccacaacctttttttatttattttataacaatattgtaaattctaccttttacataaatttccttaacgattttcttaccttcaggaatattttgtacagctttttgagcatgtactgcttctttaacttcttcttcagaagcatttctgtctacaactactttacctttaaatttaccattaatttgaattggaatttcaatttcatcggcaattgttttttcttcatcatattcaggccaagaagcttgatgtaagtatccttcaaatcctgctctttgccataattcttctgttagatgaggagcaacagggttaagtaaaataaggaatgttctaaattctgctttatttatttttcctttgtcataaacttcatttgttaatttcataagttgagctattgcagtgttaaatttaagagtttcataatcttcacttactttcttaatagtttgatgcattaaagtagtaagttctttagaatattcttctccgtcaaccactaaatcttccattttggcaactctgtctaagaatctcttacaacctttaactccgttttcactccatggagcaactttttcaaagtcccctataaacatttcatatgttcttaaagtatcagcaccgaattcgtctacaacttcatcagggttaactacattaccttttgatttagacatcttttcatgattttcacctaaaatcataccatgacttgttctcttttgataaggttcttttgtatttacaactccaatatcatataagaatttatgccagaaacgagaatataacaagtgaagtgtagtatgttccataccaccattataccaatctacattcatccaatatttaatagcttcttcgcttgcaagagcttcatcattatcaggatctgtatatcttaaataataccagcttgaaccggcccattgaggcattgtgtcagtttctctttcagcatcagcaccacatttaggacatttaaccttataccactcaggcatatttttaagtggactttcaccgtcatcagttggtttataatcttttacatccggaagtgtaagaggaagttcgctttcatcaagcggaacgaatccacagtgaggacagtttataattggaataggttctccccaatatctttgacgagagaatacccagtcacgaagtttgaagttagtttttcttcttccgattcctctttcttcaacgatttgtgtcattttttcttttgcttctttaatacctaaaccatcaatcaatggagaatttacaagcttaccgtctcctgtgtaggcttctttttcaatatctccgccgcttacaacttcaacgataggtaaatcgaatacttttgcaaattcatagtctcttgtatcatgagcaggtacagccataattgcacctgttccgtatgtcataagtacataatcagaagcaaaaacgcttatttcttttcctgtaataggatttatagcacttataccttcaagttttacacctgttttttctttattaagttctgttctttcaaaatcagatttcttagcagcttcttctttatattcaactactttatcataatttgttattttatcttttaatgtttcgattacaggatgttcaggagatataaccatatatgttgcaccgtaaattgtatccggtcttgttgtatatacagttaatttttcatcactgtctttaatttcaaaattaatttcagcaccataacttctgccaatccagttcttttgacttgattttactctgtcaataaagtcaagatcatctaaatcgtcaataagtctgtctgcatattcagtaattttaagcatccattgatttttaacttttcttacaacttctcccccacatctttcacaaaccccgtttacgacttcttcatttgcaagaccaactttacagcttgtacagaagtttattgggaattctttcttataagcaagtccttttttaaataattgtaagaaaatccattgtgtccatttataatattttggatctgttgtatcaatttctctttgccagtcaaaagagtaaccaagagattttagttgtcttttgaagttagcaatattgttttttgtaacaattgcaggatgaacacctgttttgattgcatagttttctgttggaagaccaaacgcatcaaatcccattgggaaaagtacgttatatccttgcattctcttttttcttgaaactatatcaagagcagtgtatggtcttggatgacctacgtgaagaccttgtcctgatggataagggaattcaaccaaagcataatatttaggtttgtcaagtcctgttactgcatggaaacattgttctttatcccaaatatcttgccattttttttctatttctttaaagttataattgtccatttatttctccttatttataactatttcgatttaacattaacatttttattatagttaatttatggcacttaagtcaactaaaatgtaataatttctgcttaaattatatattaaataagctttatgaaactaatatatgtataaaatttgattaatataaaaacttaattatcattttagcacatggttttatcccataaataatttatatactattgcttaaaataaatgcatatataaaaacttttgaccatatattttaatatataaattatggaggttttgcatgaatagaaaaaatatcatatttatatccgttaccgtactacttgttataattcttgcaatttttgggataatgtcaggcatgaaaaataataaaccggtagatataacaggagaatataaacttgaaaaagtgaatgttgacaaaaaagaaattgattattcaaatttaaacttctattatgtttttaacagtgattatacaggaaacataatttttgaggatgttaagagcgattttaaatatgaaataaaagaagaagacaaacaactgcttttggtaataaaacaaaacgaaaaagatgtattaacttatgcagtcacaaaagaagaaaacggaataacaataacccatgatactctgggaagtttatatttaaagaccgaagccgttccggacagtttgaaaaaataaaaaaagaagcataagcttcttttttattccaaagtattattttctcctttttggatttctcccaaaatatcaagacctttttttctcataaaataattttgtaaattctctgcacttgcatttataataagttcttcagggaatcccgctgcttctattattcctcttgctctgtctatcttacctactccaagacaaaaatgagcatctgagttaacagaaataggcacttcatattttttacataactttgctatttcaaggcaattttctttgcttccctttcttgcataaaaagagttattgtttacttcaacaactttgtcatattcattacattttgaaataactttttcataatcgaatttaaatgcgggagaacctaaatgtcccaaaatatctactcttggattttcaagtactttaagcattatttcggtaattctgtcaggatctctttcaaggaaagtttcattatgaattgatgcaacaacataatccaaggtatcaagcacatgatccggtatatcaagtcttccgtcaggctgcaatatgtttgcttcagcacctcttaaaacatatacgccttcaagaattcttggaataaacatttgaagagattgaaaatgccattgatgagctccatcttccattgctggaccatgatctgtattgcctatggcaatatgacctgctttttttgcccctttgcacatttcaataattgtagagtacgcatgatgagatacgtttgtatgtgtgtgtaaatctgctacaatattcactttaaatcacctaactttcttttatatatattttaattatattacccaaacatctttttttcaacaaaatataatgtaaaatatatatatgattattttcatatatatattttcttgctaaaaacaaaatttaatgatataatgttttgcgaataatttaaattgatttaatattaaggaagtaaaggaattatatgcggagtaaaaaactttataaaaagaaacatggttcaatgtttttcggcgtattaaacggaatttgtgaatatatcggagttgatacaataatattacgttttatatttatactttcatgtttaattttttatggtataccatcaataatgttatatatcattttagcattaattattccaagtgaagaaaaaatagaatattcaaattatgatataaattaataaacgaggaaacaatgaaaaagaaattatacaaaacaagatacggagcaaaattttgtggtgtattaaaaggattcagtgaataccttaatattgatgttacaattttaagagttatatatgttatgcttacattgctgacaatgacgataccatttgtaattttatattttgttctttcatggattatgccggaaaaagacactttgggatatgacgattatgaaataagataaaacacatcatattgatgtgtttttttattttccttttttatttaaaatagttcttcacaggttctttctttaataaaaaagaccgcatatgcggtctttctatttttattcaaaatcatttctgtctcttcttgataaagaatcctttaagaaatcaggaatatctccccagtcatttttgctttctttcttctttacaggttgttctttatcatcatctttatcttcttcaactatatcaacaagttgtccattttttgctttcatattaaaacctgttgcaataattgtaatcttaacgctgtcttccaagcttgggtcaattgccgcaccaaagattacgttagcatcagggtcagcttcttctcttgctatttcggcagctttgttaatttcgaacaatgataagtcttctccacctgtaatattaatgataacgcccgttgcacctttaatacttgtttctaatagaggagatttaacggcttcagtaacagcttctacagctttatcttcgcctgtaccataaccaacacccatatgagccattccggcatctttcattattgtcttaacatcagagaagtctaagtttacgatacctgtaataccgattaagtcacagatacctctaaccccttgtgataatacatcatcagctaattttaaagcatctttaaatgttgtgtttttatctgctagtgtaagtaatttttcatttggaataacaactaaagcatcaacatgttctcttaatagtcttatacctaaatcagaatttgaagctctaacttttccttcaaaggcaaatggtcttgttacaacggcaatagttaaaataccaagatcttttgcaatttttgcaattacatggcttgctcctgtacctgtaccaccacccattcctgctgtgatgaataaaaggtctgctccttctacgattttctttaaatcatctgtgctttcttctgcagattcttgtccaacttgagggttagcgcctgcaccaagtccacctgttgttctttctccgatttgaactttattttcacttaaagattcactcaaggcttgtgcatcagtattaactgcaacaaatcttacgccttgaagtcctccttctatcattctatttacagcgttgtttccacctccgccaacgccgattactcttatatcagcaaaattacccatatgtatatcttccatttcgtatggcataataactcctcctaaacatagtaaactaattatattctattttaatattatttttaaatatatgcaatacttttttgttatttttactacatatctgacaccatattttatattttactatatattggatttaccccttcaataagctctactttctgcttcatatccatgttttgtataaaatattttacaaaatcttcatgatatgaaaatgctgtatagtttgcaaactgaagaacgcttccatttgtaaaatataaattatattctccgtctttatttacataaaactgagaaacattttttaacagatcattttcttttaaaaattcaaatacttgtttcaaagtttgaattttcacatcatccatatcaaataaatttgttccttcttctatatctttaacttctataccggttacaatcggaacatcataccttaccaaagtattggaagatgaaagcacttttccatcatcatctacatcataaaaagttttactttcctgtaaaatgaaaaaaggagatctttcctctatatctataacaatagtattaggatattttctgtgaatatttgccttttttacaactgtaatttgctctattgcttcctctgcttttgatgcggaaaaagagtatatattctctccttccaaaataccgcttctggcaataatctcctctttggtagctatttgattattttcaacttcaatactttctatattaaacaaatccgatgtagttataaaaatagcccctgttacaacaattaaaagtacgaaaataataagaagtgatttagaattaaaaaacctgcttcttctttttcttcttttttttcttggtctgtaagttttagcttcataatagcttctgttcataactacaccttaactttttttattttccctccaagagagtttattatattatctatattttcgtaacctctttttatatgatgtatatcacttactatactttttccctctgccgccaaagcagcaataataagactcgctccgcctcttaaatcaggagcatatacctgtgcgccgtaaagtttatctacgccttcaacaacaagtgtacttccctttacattcatttttgcccccattcttataagttccaaagtatatttaaatctattttcaaatatcgtttcgttaattatacttaccccattcgcaattgatagcattgctcccatttgagactgcatatccgtaggaaatccgggataaggaagagtaataagagattttaaaggcttaatattatcactgcctcttaccaaaataccgtcactgtaaattttaaacatctctcccgtttcaagaagtttataataaacagctttcatagtatcaagctttgcattttttataaaaaaacttgaacaagtcatatttgcaagacacataaaagtcccacatactattctgtcactcattattgtatattcggtattttttaaacttctaacaccttctatatatacggtatttcctcctgcaccgtaaactctcgctcccatactgtttaagaaattttgtaaatcaattatctctggttcttttgcagggtttcctattgccgtaacaccttctgccaaaacagaagcaagaataatattttccgtaaccccgacacttggaaaatcaagctgaatatttctacccctgattttttcaccttttaaggtaattacaccattttcttctatcattttacacccaagttgctttaaagctttaatatgtaaatctattggtctaagtcctatatcacatccgccgggcatagaaaaactgcattccctttcaagagataataccgcccccattaaaatgagagaagaacgcattttccttaaaagtttatcatttaattttactttatttatatcttttgaattaacaatcacactatgatctttcttttcaacataacagcctaaatccttaagcatttcaatcatagtatttacatcttctatatcgggaacattatgaataatactttccgatttatttaaaaccgatgctgctaaaataggtaaagcagcatttttgcatccctgtaaatcaatctcaccgcttaatctttttccgccttcaataacgaaactttccataaactacctccaaagccatttagtttataatattcatattattttattattgtgaatacatagctttgaaggttatataatttttatttgtttttagtaagcttttccacttcgtccacaatacgttctgcactgtcttttattgatagaagttttgacatataactcatttgtttaaaataactttcgttacatataatcttcttaacttcatcaataagtctgtccccgtttaattcatcatcaagtatcataatacccgctccggcactttctacctcttcagcattttttctttgatgatcatcggcagccaacggataaggaatatatattcccgctaatcccacatatgtaatttccgcaatagcacctgctccgcttcttgctataacaaggtctgctgcatttaaaagcacaggcatatcataaacataatcttttatttcaacgttatggatttctccgaaattcaaacctcttttctttgcattttcaaggaaatcttcatatccgtttttaccggttacatgacaaatatagatatcatcatcatttctatattcttctattaaagaaagcatggcatcatttaaatttttagcaccaaggcttcccccaaaacatactataacttttttatcagaatctattcctaaagtctttcttgcaatttctctgttatataacccaaactctcttcttactggattacctgtatatacaaccctttcaggatgttttacatattcttttgtattttcaaaacttgaacatacgatgtctgcccattttgaaagtgttcttgtagtaaatccgggaactgcattttgttcatgtataagagtaggtttaccttttaaagctcctgccagcacaacaggaccggaaacaaatcctccggtacctataacaatatcaggattaaaactatttacaagctttcttgcgtcgttatatcctctaaacattttgaaaaatacagataatttttttaatttagaatagtatctttcaaaaccgtatattcttatgttattaagttcataacctgcctttggaactatatcagcttccatacagtcatttcttccagcaaaaacaatttcagcatcaggatattcatattttatctgatttgctatggcaacagcaggataaatatgtccgcctgttccaccgcctgcaattaaaattttcatttcttttcctctctataagaacaatattatataactcttaattattttttgataaatttaaaattaaaaaactattaaataactttattttataaaaggattaattttaacattaatccttttataaaaattattttccataatttacttatatacggcagtgttttgatatattaagaactacccccataccgcacatcagagaaataagtgaggaagcacccgcacttacaaaaggaagaggcatacctgttacaggtaaaagcgctgttgcaacaccgatattgataaatacctgcattccaagcaaccctgccattcccccactaaataacattgagaaagaatccggagcatttagtgctataacgatacatctccatattaaaaataaatataccgcaataagtattattccacaaataagccccatttcttctcctatatgagcaaaaataaagtcattttgaggttccggcataaaaagaagttttgcttttccttctccaaatcctctaccaagtaaaccgcctgaaccaagagccattaaagattgacaaatctgccaaccagaaccttgtatatcttcccatggatctaagaaagtaagcattctggtaattctccaaggagtagttataatcataaatacaatacccgaaacaccaagtcccgcaacaggaataaaccattttaaattcattccaccgattattaacatacctacaataagtgcaccaataatcgttgcagtactaaggttaggttccaaagcaataagtccgcatacaatcattgcaagacctatataaggtaaaattccgtatttaaaagttcctataagttcttttttcttttcaatcgaataagacaaatataaaataagtgcaacctttgtaaattcacttggttgaatcgtaccgatttttatatcaatccatctttttgcaccattaacatcaacacctataaacaaaaccaaaataagaagtaatattgcacctatcattactattggcgcaaaatgttttaccactttataatctatatttgaaatggtaatcataagaaaggttcctatgatggcaaatataagctgctttgtaaaataggaaaaaggacttccttcaagacccgaattatacatacttgcagaaaaaatagatattataccaaaaacagttaaacctattactgtaagaagaagccaataatccattgtcccttttctttttcttacttctctcatataattatcctttcagtttgtttacgtattctttaaatactcttcccctttgctcataatcatcaaacatatcaaaacttgaagtcgcaggagaaagaagaacgcattccccttcatttgcaagttttgtagcttcttcacaagctttaataaaatcatcttctacaacaacgtaatttttatatccatatttatcaaatgtatcctttattttgttttttacaactccataaagaacactacatttaatattatcattaaggttttgtgccaaatcgtcgaaaggtgtctgtttgtcataacctccaagcattaaaaccgtttttttcttcattgcctttattgccgttacggtcgcatctacatttgtacctttagaatcatttatatattctattccgtcaaccgtatcaacatattcaattctatgttcaacacttttgaaattttctaaggtattaacaagattttctttttttacgcctttaacaattcctgccaaagatgcacacataacattcattacattgtgaagtccatataatttaagcttatttatatttataagctcaaaaacttcgcctttaaagttaatcattatattttcgttttccaaatatgcgtttgcatctttatcgtcttttgtagtaaaagtcaaaacattgcttttagcttttttactaagttccattacaacattatcttctttatttacgataagataatcattttcgtcttgatttaaaaatacgtttcctttaactctgacatattcttcaaaacttccgtgtctttccaaatggtcaggagtaatatttgtaattatagcaacattaggtttaaacttatctgtcatttcaagttgatatgaacttatctcaagagaataaacgctgttttcatctccctttgccgcatcgttaataaatgcatctccgatatttccgtttacatatgtttcatacccggcatttttaaaaatttcaccaacaagtgtagttgtagttgtcttaccgtttgtacctgttattgcaactttatatcctttacagaaactattggcaaattcaaattcactgtatacgggaatattgtttttcttcgccgtaacaataggaaaagcctttggaggaacagatggcgaaactataaccatttcgcactcttttatttcctcttcacttggttgtcttccaagaataaatttaatattttcatcaccaaccaaagtgtctattccaaatccaagctttgctatatcttcatattcttttgtatctgttaaatatactttcttattttgagatgaaagaaatcttgaaacggaaacaccgcttctgcctccacctacaaccatatatattccgttttttaattccatttttttctccttaaccaaacataattggaagtgacagcaatgatattaaaacaagtactgccgtagtaatccaaaaacaagttactatttttgtttcatgatgtcccaaaagttcaaaatggtgatgtataggtgccattttgaaaagtcttttaccccctgttttcttaaaatagaaaacttgtaatataaccgataatgcttctataagatatattcctcctgcgattaaaatgtaaagttctgatcttgtaaaaatagaaactattacaaccgcaccgccaagagccattgaacctgtatctcccataaaaatcgaagcagggtgagcattatagcataaaaagccaagacatgctcctattacacttgcagtaaatatattcatagaagtaaatccgtttgcaagagaaaataccaagaaaaagaataatattatcatggtaactccgcatgcaagtccgtctaatccgtctgtcaaattcgccgcattaacgacagcaactattgctataataacaaacggaatataaaatatacccatattccatacgatattggtaaaaggtattacaatactcgttccgattgttggatgaaatgctgcataaaccgcaactgcacccgcagccgaaaattgtaaaagcaatttctgtattggaagcattccaagatatggaacaagaaccccaccttcagaatttaatctgtttttttgaaccatttttatataatcgtctaaaaatcctataagaccgaaaatcaatgttacaaataaagcaaatattaaatctccgtcagcttttgtaaaaaataatgcacatgtaactaaaataccaagcatcattacaagtccgcccattgtaggagtacctgcctttttataatgactcttcggaccaagctcccttatagtctgccccatttttagtctttgcaaaaaaggaataaatttaggtgttaataatactactattgtaaatgaaatcagagttgaaagaattacatatatcattataaattacctcccctttttaggctgtcaattacatcttcaaaagccattcctctggatgctttaaataaaatataatctcccttaaatgtcaacttttctatttgtttcattaaatcatcttttgaatcaaaatgttttatattttttttctcaaaaccgtaatatacggcaccttcccctatttgtctgctatgttctcccgcagtaataagaaagtcaacttcattttgtactatatcttttccacattcaaagtgtagtttttcacttttttctccaagttcaaacatatctccgagaaccgctacttttctattattgccacttatgttcttaagtaaaccaagcgcctctcttaaagcatcagggttggaattataagtatcgtttataagagtcattccattataatcttctatatccattctgtttttgcttgctttaaaactatcaagtcctttttgtatctgctcataagtaagtccaaaagcaaatcctgtatatattgcaacaagcccgttataaacactgtattttgcaggagtttttaatttaaaagaatattccttatcttcatatttaacattaaaactcacaccgcttttatcataaacaatatcgtaagctttaaaatctccgttttctattcctatttttacaatattaaattcattgtttttataatccttaaagaactcattatctgcgtttacaacaagagtaccgccttttttaagtccttttgtaatttccatttttgctttaaaaatattctctttgcttcccaaattttcaatatgggttacccctacatttgttattattccaaaatcaggttcaacaagtgagcttattttttcaatttcacctttgtggttcattcccatttcaacaactgcaatctcatgttctttatttaagttaaataaagtaagaggagcacccgttgtgctgttataattgcctattgttttcattgtgttatacttacttgataaaacacttgaaaccatatcttttgtggttgtcttaccggcacttcccgttaaagctataaaaggaatcgtaaattcacttttataactttttgccatatcataaagagcctttagagtatcttcaaccttaatttgataacagtctgcgtcattgacaagtttagtaacgacacaacagcaagctttattctcgactgcttttttaacgaaatcatgtccgtcaaatgcagttccgggaagtgcaaagaatacacttccctcttttgcaagcctgctgtctattaccacatcggttattattttattatttccttctttaataattttgccgccaagcattttttctaattttaatatatcaatactatgcattttctacctcaaacttcaatatccgcattattatatcactttttggcttttgttaaaacaacttatatataaaatacaaaataattaatcaacatattcaaaggttaccgttacttttgttcctttcttaacttttgtaccggctttaacgctctgtttcgttgctataccaccgcctttaacttctatggttagccccaacttcgttaatgcttcgtttgcgctttgaacactcatacccgttaagtcaggcatagttacttccgtcgaagaagagctgtcaacagtaatggtaattttcttactataagtttcttgtacatttgtctgacttatgactattgcatcattatcttttatatttttagttttgtattttatttcataatctatatttagtgaatcaagaagactctttgcatcggttaaactttctcctctaacatcaggaacaacaacctttgcatttaatgtcttaacatcttcactgtcagaatcagattttgtattcaaatagttaagtgagtttttaagaatttctgctgctataggtgcagctgtagtacttccgtaacttccgtttgtaggttcatccaaaattactataactgcaatttgaggattatcatatggtgcaaacccgaaaaaactcgtaacatattttgaatgagaatatttaccatctattatcttttgtgccgtacctgttttaccacccatttttaaatcatctgaatcatactgtgataatacactggattttgatacaacacttcttagatattttctcattgtattagaagtatcgcttgaaataatttgtcttacgacttctttatcatatgttgtggttatttcattattttccccttctgttacatatttaacaagttgaggctttaacaaatatccaccattaattacagcacttaaagccatagacatctgaattggtgtagtcgacagcccttgcccaaaagattttgttacataatctactatatttacattttcatttggagataaaataccgctttcttctcctcccaaatctattcccgtttttgagccgaatccatagttatatatataatcataaaaaacatcaggtcccatacgcattgctatttccatcattgcagggttacacgaattaataagcgtttcttccaaagattcgctgccgtgagcatttgggtaaaccgaacaccttatctttgttccggcaactactttatatcccgagcagtaaaaccttgatgatgttgtaatagaaccttcttcaagtgccgccgaaacggttatcggtttaaatgttgagccaggttcatagtttaaactgatgtttgggttatcccacattaaagcaagcttttcactttctgtcatttttcttttcttaccatcatcatcggttgtataaaaatcagaactaaaattatcttcaaaatcttcatcaagttcccatgggtcatttaaatcgtaacttggatttgatgccattgcaagtatctctccagttgaaggatcaatggcaatagccaaagctctctttgctccggtctttttaataccggtttcaagtgcattttccgcatacatttgtattacactgtctattgtaagaacaagattacttccatctgtagcttcttgtcttatttcacttcctgatgcaatttttcttccgcttccgtctgtttgatataaaacaactccgtctttacctgaaagaacatcattaaaacttgcttccagtccatataatccttgatggtctgttcccgtaaacccaagaagatgtgccgcaaaagtaccgtttgtgtaatatctttttttatcttctgttacagaaacacctgtataacccttattttttatctctaatcctatactgttatccactttgctttttataagctcattacttgaagatgaattatttacttttttataaacttcatcataatctaaatcaagcatttcacttaaatattttgcaacttcttccttatcttctttttctatgcttgcaggagaaacataaatacttgaacaagttgcgtcttttgcaagtaaagccatgtttctgtcataaatatctcccctacttgccgtaataggaagacgctgcatcaacatggctgattgtttatctccgtattcaactgctttaaatccttgtatgtaaacaagttttacaacaagtgcaacaaacagcacacatacaaaggaaaatataaataaaattcttttctttcgttttaaatctaaaaaagttttcaaatgttaccaccttcattagttactgacgaaactgtcaaaaagtttagagagtgcactttcgtctttagtattttgagcgcttgcactctttgttgaggaaattgaatcagaattatctgtcacatcaacagcaacaaaagaactgctacttggtttaatcataccatatttttttgtcgcaatcttttgaacttccttcaaatctctttttgccagcaatttcccctctaaactgtcgtttagcatttgaacctcttttaattcactttcaagattagatattgcaatatccgttctgtttattctgtaactttgccaagtgataagagaaacacatatcgaagcaactaaaaacaaaaataaaacagtatcaattgtaaaaatcttttcttctttattaacattttttctaatctgcgcattattatttcttcttgtcatttgctgctccttaaattatatttgaaaaattttcttattattacttaaagtttctctattgctctaagctttgcacttcttgaacgtgggttattttctatctcttcacctgtaggaagaataggtttacccgttagaactttcacttttggcttattcccgcatacacatactggaaaatctttagggcaggtgcaacccttctttttatcattaaacactttctttgtgattctgtcttctaaggaatgaaaggttattaccgcaagccttcctcctttatctaaaacatcaatcatatcttccacagctttttcaagtgcatctatttcgttatttacttctatcctaatagcctgaaaagtctttttcgctggatgtttttttgcgtgaaacttttttggaattgcagcttttattatttctacaagttcaaaagttgtttcaatcggcttctcttcacgcctttttataatatgttttgcaatatttcctgcaaattgttcttccccatattcacttatgattctttttaaatcttcataggaatatgtattaacaagcttctttgcatcaacatcgctggttctatccattctcatatcaagtggaccgtcatgcctaaaagaaaatcctcgtttttcatcatcaatctgaaaagaagaaactccaaggtcaaccatcatgccgtcaatcttatcaataccaagttcttctaaaatactttttatatcgtgaaaattaccttttacaaaatgtttttcacagttataaggagaaagtctttcttttgctctgtcaaacacaaaatcatctctgtcaattccgataaatgttcccttatcggataatcttttgcatatcccttcactatgacctgctccgcccattgttccgtcaacaaaaataccatcaggttttatatttaggatatcaagggtttcattatataaaacgctaatatgtttcatcttaaatatttatccccgcttcatacatttcttgagctacatcattgatatcatcatcagacatatcattgaaactatcccactgagctttatcccagatttcaactttatcttcaacaccaacaacaacaatatccttaattattccggcatattctataagagcctgtgcaacttttgttctgccttgtttatcaggggaacattcgcaggcacttcctaaaataaatcttgaaaatcttcttgcatttctatcggtagttggtaagcttttgatttttgctgcaagttcttcccaagcgtcctgtggataaacccagatacatttatctagacctttacacataataaaagaatccccaagttcatttctgaatttggcaggcacattaactcttcctttactgtcaactgtgtgattatattctcctattagcataattcttaccactctatacccgtttatgttctcattttaccacttgataccacccttggcaaccaaatttgcttaaaatttaaacttttttgataattttaatatttatagaacatattttctaaacaatctgtggacaagttgtgaataacccttataaaaatatttatttataaaaatcacttatcttgtaagaatattttgggtatgatataatatacaaagtggcgcagtatcctagtcagacttattttgattgaaggcggggctaaaaatccgtcaaagggcacatcgatgaagtttcttgtttgggcttcttacgcccagtaaggggttctttcaggaagtaaaggaaatggggcgatctgcaacggcatgtgggcgatgaccctatttccgcggaggctcataagaatattcttatgggagaaacctatggatgtggtaatccgggggatctcgtgattattactgaaatagcgtagcctgttttgagtgatgcagggggagttggaaaccaactttttatcaatatgagctcaaagataagaaagtattgccaatgaaacctgtgttgcaaaagaaactatgtcatcttaagcctgccgaggaaagctcctaggctgtttcatttgaagataatttagggattacagtgtgaactaagtggtaatttggtcctgcccgcagcaatgaggcaggaaaatattgaaagggaaaccgcaattacggcgacgtttttgtatattttcgggaaatcctaccaaacctaagtcgcaaagtttacttaagttattgccactaaaaaaagacaggtgttaacctgtcttttttattaccataaaccacattgtacaataagaacttcactccaaaaaccctatacatatgtaaaacccgtcaaacttaagaatctttatcttttataccaaattttttaggacaaacaaaaaagaatgaaattatacacttgtgtatccataagaaagtaattttaactttttgtctgcagcccctataaatttacccgatacatagaatatgattttttacaaccccattgatgataatagacgttaattcccgcatttccatatacttacaaataacgttaaagaagcggaaaaatacctactaccctattcataaatataaacatcgtattgttcagaattggcagactctgtcaattccttttaccccgattcatactcggcgtatagttgcaaaaatctttcatgacttatcgcttcattaatatcgccgcttaagttcggtaatcgctttacttatctatccccaattatttttctgtcacttcatttcattagcttttccattcgttctttactttgtaatgaaataagtttcttagcaagtataaaaagaatatctttccctaaaaatgtattgtactttgcttattagataggaaattcccaaagtcttctgactttttttctctctgcttgcaacacaatacaaagtgtttttgccgaagtattgaaagaaatgttataaaaatatttcttacttttaataataatgataaaagttaaaaaataccaacgccataaacatggaataaaatctacaaatttttaactattgacaaatattttgatttatcatataatataacagtgatatataacagtgttatacaaggatgagaatatgagtgaaaacaaacaaacaacactaaatctgattctttcaacggcaatgcaggaatttcttgaaaaaggttataagtcggcttctttgaggaatattgtcaaaacagcaggcgtaacaacgggtgcgttttatggttactataacagcaaagaagatttatttgaagctttggtaggcgaacattacaattttttattgaatcgtttctgtaaagctcaaaaagaatttgcagaaataccaccggaaaaacagcccgacaatcttagctctgtttccggagaatgtatgtatgaaatgcttttgtacatatatgaacatttaaatgaatttaagctcatactttgttgttcggagggaactcgtttttcaaaactgatcgatgaaatggtaaaaatagaaacaaaaggtacacatgattatttgacggttcttgaaaagctagggaaacctgcacctccaatcgataaacgtttagagcatattttgattacaggaatgtttaatacttttttcgagctggttatacatgaaatgccccttaaagaagcaaagcattatctgaaagaaatgagagctttttatactgccggatggatgaaaatcatggggcagtcagaacaatccaaactgtaatttttaataaaactataattgttaataatggaaagtgtacactttccattatatttggcacttaagttagcaatgactaactcgtaaaataatattatcacaataaggatattcgaattcggttatttaacattctatatcataaaaaatttctaaggagacttttataatgaaaaaacagtcaaatctatcaagattgatggactatgccggaaaatacaggatattaacttatctttcttgggtattgtctgtaataagcgcattattggcacttgtacctttttggtacatatggcgtatcattcactgcatactggaagtttcaccgaacttctcagaagcagcgaatgtcacggaatacggttggtttgccgtattgtttgcgattgtttccatagttatctacataactgcattgatgtgttcacacataagcgcgtttaggattgctgcaaatatccgaaaagaacttatgcatcatattgcgtccctaccgcttggaataacagaaaaatacggaagcgggaaactgcgaagaattgtaaacagttccagcgccgctacggaaacataccttgcacatagacttcccgacaaagcgggcgcaattgctactcccataggattgcttttcttgttgcttgtttttgactggcgattggggcttttaagtcttgttcctgttgttcttggctttttgattatgatgaaaatgacaggaaaagaaatggaaaaacgcatggaacaatatcagaatgcactctcggatatgtcaaacgaagccgttgaatatgtaaggggggtgcccgtagtaaagactttcggacagacggtcttttctttcaaacgttttaaaaaggcaatagataactatgaaacatgggtcatagcatacacaaaatccttgcgtatgcctatgctgttctatacaacagcaattaatggagtattcgcatttctaattgccggaggtatcatatttaccggaaacggcgtaacaaatgaactgttactgaatcttattttctatattgtgattactccagtcattggcacaacacttacaaaaatcatgtttatgagtgaggatacaatgattgtggatgacgctttcggcagaattgacgaagtgttaaacgaacaaccattgtctgaaagtcgcataaataatatccccaaagacaatggtattacattggaacacgtcagttacagttatgatggaaagaaaaatgcgctcaacgatatatcactttccataaagccgggacaggtagtagcattggtcgggccgtctggtggaggtaaaacaacgcttgcaaatatcgttacaagattttttgaccctcaaaaaggacgtatactgataggaaatattgacatacgcaatattccgaaagaaacattgatgaacagagtatcttttgtttttcagaacagtcatcttatcaaagcgtccatactagaaaatgtacgcatggcaaaacccgatgccacacgaaaagaaatcatccatgctttggaggcggctcagtgtattgacattatcgaaaaattaccgaatggtataaatacggttgtcggaacaaaaggcgtatacttgtcaggaggagaacagcaaagaatagccattgcacgcgcaattttgaaaaatgcacctatcctgattcttgacgaagccaccgcatttgccgacccagacaatgaagtacgggtacagcaagctttgtcggctctctcaaaggggaaaacagttattatgattgcacacagactgtcatcaatcacagaagccgattgtatttatgtgttgcaaaatggtgaaatcatcgaaagtggcacacacagtgagctggtagaaaaaaatagcgtattcgcaaaaatgtggaagaattattccgaagctgcggaatggaaaattgcaaaggaggtaaacacatgattaaaatacttcaaagacgctttgcgttatcaagacaaggggctattgatttaataaaaggttgtattgcttgtgttgcacaggatttatcgtttatgtttccagttggactactctattattttgtcattgatactatgaatggaggggtaaccggaaaccgcatcgtcttttatataatcggagtgttggtttgcttatgccttatattcattgcaacttggtttcaatataacaccacctatttggcaacttacgtggaaagcggtgtaagacgtatatctttggctgaacaactccgaaaaatccctttatcgtttttcggtaaaaaagaccttgccgatttgacaaattcaattatgggcgactgtgccacactggaaacaacattttctcattacgttccagctttggcaggttcccttatttcaacaacactgatttccctaggactttttatctatgattggcgtatggctcttgctgcagtttgggttttgccgattgcatttgctattacatttttttcagctcgcatacaggagtacttcaacaaaaaatccgttgcagcaaatgttgctcttgaaagcggagttcaggagtgtatcgaatgtctgcaagacctgaaatcaaacaatgcagaaaaaagctatttaagaaagcttgataaaaaaatcgaccatgtagaaaaacgtcacattataacagaactcggaactgctctttttgttgtttcttcaacgcttatattaaaatttggaattgcgacggttgctctagttggttctacgttactcattcgcggagaaatcgatattccgctgttttttatgtttctacttgtagcttcaagattatatgctccccttgaaggtgcattacaaaatcttgctgcggtaatttcttcaaaaacaaacataaatcgtatgaatgaaatttttgatcaacctatacaaacaggcaacaatcggttatcaaacaaaggatatgacattgtatttgaccatgtgggattcgcatatcatacgggagaaacagtattaaaagacgtatcctttaccgcaaaacaaggagaagtcactgccttagtcggaccgtccggaggagggaaaactacagtgtcacgccttgccgcacgtttttgggatatcaataaaggaaaaatcacggttggtggtatggatatatccaaaatagaaccggaaacattgctgtcactatactctatcgtatttcaagatgtgactctgtttaacaatacaataatggaaaatatcagaataggaagaaaagatgcgaccgatgaggaagttcttgcagcggcaaaactggcaaattgtgaagaatttgcaatgaaactaccggacggatataacagtatgatcggtgaaaacggatgcgaattatccggcggcgaaagacaacgtatttcaatagcacgtgcttttctcaaaaattctcctatcattttacttgatgaagcaactgcaagccttgacgcagaaaacgaaaccttgatacaggctgctttatcaaagcttataaaggataaaaccgtacttgttatcgcacaccgtatgcgtacagtaagcaatgctgacaaagtggttgtactttcggacggttatgttgccgaacagggtacaccggaaaaccttatgaacacaggtaaaatttatccacatatggtaaaattgcaaatgaccggtatggattggggcatctaaaatgaatactgaatggataatatgtcctatgtgtcaaggaaaaacaaggttgaaaatacgaagcgataccgaactaaaaaatttcccgttatattgtccgaaatgcaaacaggaaattctgattaacgtatatcagatgaatatatcagttatcaaagagccggacgcacagacgcagagccgataacaagcaaattttgaaatgctgttatccgctctttttttataaaaatcaatacgacgatatggggaggtatcgtcgtgttactttttttatcagaaaaatcaaacagaatatcttttataaaaaaattcgatattcatttagataatatattattacgagcatgaaatgataattcacacgatatatatagataaatcacataacaagtaacggtctttaaactcaataattatatattacacaaacgctcattcaacttgattttttatgggcgtttgtcgtaataagccctacctggaataattagaaacagttatgatgaaatatacagagcaatccataaacataccgagtgtacctttctccttttctgtaaaggcgtcctccgcaataatgcaattaacacatccccataataaaacacaagcataaagtataacctgactgtacaatgaagaaaacatttaataaaccttttacaatcgacaactactatgagtaatgtatctgcgaagaggcgacgtttttgtatattttcgggaaatcctaccaaacctaagtcgcaaagtttacttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttttgtatattttcgggaaatcctaccaaacctaagtcgcaaagtttacttaaattattgccacttttaagacaggaattatcctgtcttttttacattcaaaaaatattcatctcgattttctttaccaatgttcttatttcaatgttttttatgttataatccgtttaaaattataaacaaaggagtcattatgaataaatgtataataaaaaaacaaattatagccaatgacctaaacaaatgccaaaacctatttatagcactgggaaatgaaaccagacttaatataatcaatacaatgctcacaaatgaaaatacgggaatacgagttggagaaataactaaacagacacatctttcaagacctaccgtatccaaccatctgaaaatactcaaagaatccggcattatctcattaaagaaaaaaggcacaatgaatttttattatataaatacacaaacttcaaaatggaaagaattaaaaaaattaatagacgatatttccttaatcataaaaagcattgacaatcaggaatatcaaaaaaacatataaaaaaaagaagtaatatgaacttaaaagaagctgcacaaaaaagacattcagtaaggagctatcttaacaaaaaaatagaagataacaagatacaaaaaattcaaaatataataaatgaatgtaacaaaaaaaatgattttaacatacaatttttacaaatgaaccaaatgcttttaactgttttatggctcattacggaaaatttgaaaatgtaagcaactatattttattaatagggaaaaaggagaaaatacagaagaaaaacttggatattacggagcaaaaattgctcttgaagcacaatgtatgggacttaatacctgtttcgttgcaatgacatactcaaaaaagaaatcaccttgtaaattaaaaaacaacgaaaaaatatactgtgcaatttcaataggatatggaaaaacggaaggaataaaacataagtcaaaatcatacgacgaagtaacggaaataaaaacagaagaaaaaaactggtttaaagaaggcgtaaataccgccttacttgcccctaccgcaatgaaccaacaaaagttcaaaattattttaaacgaagacaatagtgtttcatttaaaagaggaaaaggaattcttaccaaaatggatattggaatagtaaaatatcattttgaaataggttccggaaaataaaagaaaatggatatatcctcaagtaatgttaagccatataatattttcagggaaacaaattaaaggttaagttattaataaacatatcaaatttgtaaaagacattaatacctaaaaaagaatattttactgaaatcaacaatatatataaatgatatcaattcatagctttatattaaaaacaaaatcttacataaatataaaataaaaagagtgcataagcactctttttatttttctatattaagaaagaagcattctgtcgtttgcaaactcaccgccggaacacatttcaaatttttcaagcaaatctttaacttgaagatttttcttttcctctcctctaacatcataaataatatgtccgtcatacatcataataagtctgtttccatatttaatagcatctctcatgttatgtgttaccattaatgctgttaaattatctttatctatgattttttgagtaagctctaaaacttttgctgctgttttagggtcaagagcagctgtatgttcatcaagaagaagaagttcaggttttttaagtgttgccattaataaagttaatgcttgtctttgtccacctgatagtaaacctactttatcgcttaatctgtcttcaagtcctaaatcaagagtttttagaagttctctatattcatctctttcttcgtttttaattccccagcctagacctcttttatctcctcttctatatgccatagcaagattttcttcaatcatcatgtctgcggcagtacctctcataggatcttggaaaactctgcctatccatcttgctcttttatgttcatcaagagttgtaatcaagtggtcagctaatgtaattttaccgctgtcaacaggataaacacctgctatcatatttaacattgttgatttaccggcaccattaccaccaataaccgtaacaaaatcttgagggtatagatgtaagtttatatctattaatgctttcttttcatttatagtaccttcattgaatgtcttatttatattttgaagtttaagcattttctacacctccccgccattcatttctttgtttaattttatttttttcttttcgtttatctttcctttaattataggaagagataatgcaagagcaactattattgctgttaatagttttaagtcgtttggattcataccaagtcttaaaacaactgcaattattactctgtatatgatactaccaagaactacgcttataagctttgttttaaatgatatagccttatttaagattacttctccgataataatagatgcaagaccaattacgattgtacctgttcccatacctacatcaccatatctttgagattgtgcaaccattgcacctgacaatgaaacaagaccatttgaaataataagaccgataattttcattgtgtctgtattaacaccaagagctcttaccatatccccattatttccggtagctcttatggcgcatcctatttctgttccaaagaaccagtataaaataaccattgctaaaattacaataattagcccgaataataatgttgcatttgaacttgaaagtcctgttaaatcacaaacataatctattactgttttaacatttcctccaccaagttgtggcattgctaagtttgatttacctgccaaaacttttaagttaattgaataaagtgcaagcatagacaagataccggaaagaattgcaggaattttaagtttagtatgtaaaaatcctgttacacatccggcaagcataccggcaatagtagcaactattaaacttaaaataggattaatgccgttaacaacaagagttgctgtaacacatcctccaagagcaaaagttccgtcaactgtcatatctgctatatccaaaattttgaatgtaatgtatactccaagacacattacaccccacaaaatacctaagcttatggcatccggcaggtttttaagtatacctgtaagaagttccatattataccccctgaaatttgtataatttaatatttaaaaaaaatgaaattttctcaattttcactattattttattttactattattttatcaacttttcaatataaaaataatatttctatgatgtatattaaatcaaaaaaataaatatttataaataaaaaaagaggtatataaatacctctttaattttttattattttaccagtttatcttctaaacttgaaggaatttccatatttaatgtttttaatgtatcgttattaacaacaagttttaaatcatccccgcttaagtattcaataggcatagtagaaacatctgcttctccttttagaacttttacggcttgaagacctgttttgtatccaagatcataatagtcaataccataacaagcaagaccaccgtctgttgccattgcttgtgctccacagaatactggaacttttgcttcatttgttacaagagcaactgtagccatacctgctgcaaatgtgttgtctgtaggtatgtaaattgcatcaactttatcaattacagaagaaacaacttgttgaatttcatttgagcttgaaacagttgcttcaactaaagtaagaccaagtttttctgcttcttctttagctatctttgcttgtaaaactgagttcgcttcatttgaagaatataaaagtcctactgtttttgcttcaggacaaaattcctttaatacttcaagttgatctttaacaggtgtcatatcacttgtacctgatacgtttgtttcaggtttttcgtttgatttaacaagtcccgcatctgcaggatctgtaactgctgttactaaaataggaatatcacttgttttgcttgctgctgcttgagctgcaggtgttccgattgccaatatcaaatctttattgtcatttacaaatccatctgaaattgtttgacagtttgattgatcccctgctgcattttggaaatcaagttcaatattttttccatcttcatatccgttatccttaagtgctgcaacgaaaccttcataagcagagtccaaagattcatgttgtattaattgaataactccgatttttttcacttcatcacctgaactgtctgaaccacaagcactaaatccaaggacaactccaaggcaaagtaatactgaaataatcttttttaacattattttcccctccaaaaaataaataagaattacaattattatatatttatattatttttttatttgactcataatactatcaggtattgttataccaagagttttggcagcttcttcatttacagccatttccaaatcttcttcagctaaatattcaataggcatatcttcaactttcgcttcaccttttaaaattttaacagcttgaagacctgttttgtatccaagattatagtaatcaataccatatgttgctaaagcaccaccttcaagcatacctgattcaccacaaataataggaacatttttttcatttgcaaccatagctactgtggctatacctgcagaaaccatattatcagtaggaacataaagcacatcagctttatctaccaaagaagatgcaacttgttgaatttcatttgaatttgatactgttccttcaacatatgtcattccctttgcttcaatagctttttttgcaataccagcttgtaatatagagtttgattcgtttgaacaatacataactccaactgtttttgcgtcaggaacaatttgttttaataaatcaatttgttcctcaacaggagttaaatcgcttgtacctgatacatttgtttcaggtttttcatttgatttaacaagtcccgcatcagctggatctgtaaccgctgttactaaaataggaatatcttttgttttatttgcaacagcttgagctgcaggagtgcctattgctaaaatcaaatcttttccgtcatttataaaactatcagaaatagtttgacagtttgattgatctcctgctgcattttgataatcaacttcaatgttttcaccatctttaaatccattatcttccaatgctttcataaatccttcgttagctttatcaagagcatcatgttgaactaactgaagaacgccgattttgtatactttattacttccgtcattagaaccacaaccgctaattcctagaaataacgctaaacaaatcgtaattgccaataatttttttgccattttacttctcccctataatttaatttatattaaaaattattgtactataacaattaatataatgtcaataattttctgaaaatttaggagatttaatgggtttgaataatatattaaatttaaatttatagttttaatatagtcatttatctaatgatatttataattattcatctttagaagaaagccaagcacctatagccattataaatagagcaatgaaatatctaatatcaggaaaatctctaaaaataatcaatgatataattgccgatataaaaggtgcaacagcataataagcacttgtacgagctgcgccaagcaatctttgagcaaatacataaaaataaatacttaaaccatatgccacaaatcccaaaaataaaacagcaataatattaatcccaacttctaccttttctccaatacatagccctataataacagatcctaatcccgaaaatatcccttttaataaaacaatctgcaaaggatcttttaaagatatttttcttgtgcagttattttcaaagccccaacaaatagcagcaagcagcacaaataacgaaccatatgaaaactttatacttgatacatcttcaaaagataaaattccacaagatagtgaaacaaaaaatatcccaaaccataatcgtatacttattttttctttaaacaccataaaagcaattattgctgttgcaacaatttcaaaattattgagtaatgacgtatttgctgcagttgttaaccttaaaccaaataataagcaaataggagcagcaatatctaaaacaatcatagctatagtataaggtaattcatcctttgttaattttaattctttaatttgagtattttttatttttctaataataaaaataaaaaacattcctattccagcacccaaataaagaaagccagccattaaagtggaaggaatataatctaataatatttttgaaaaaggagcattaattgcatatagtgatgccgcaaatatcgcaaaagctattcctcttttaatatttaattcttctttcattttattgacactccctaaaaaaatattatataatttgtatgttatcttacattttgttcgattatatcatatgaatatttttcttaacaacaaataaatatatcgaaatgtaagttaatgaacaattttgtagatttgtacggagaaatataatggatagacgacaacaaaaaactcaaaaagcaatctttcaagcatttagcacattaattggtaagaaaagctacaatcatattacagtacaagaaataattgatactgcaaacattggcagaagtacattttatgctcattttgagactaaagacgaattattaaacgcagtatgcaaagaactttttgaacatattataaatagtgcagtaaacacctcccacacacatggactttattcaaatgaaaaagctccaaaatccgttttttgtcatcttttacaacatttacaaaaaaatgataacaatattttagaattattatcctgtgaaagtaacgaaattttccttcgttattttaaaaacagtttaaacaaattaataaaaacacaatttataaatcaaaatttaaaattaaaccccaatattccgcaagactttattataaatcatatttcaagtagctttgtagaaatggttttatggtggacaaaaggaaacaaaaaacatacaccaaagcagttagattactatttccgttgtgttatagagccgatttttaaaacgccagaaaactaaattctaccttgatacagttgctccttgctttaaatataaatttttatatcatcgatttgttttatttataaatttattatttgaatcatttatttttctcattttttctttttaaatatatttttcattcatcatctagaatttcaaataaaaaatataattaatgtaaaatatggactttaaaagtttgtaatgttatattatatacaaagaaattaaaagaagggaaaaaatgaaatttttagataaactatttagcagaattgttattttcggcatattacttatattacaggtattcatgttatttttcgttgtagtaaaattcagcgaagtaaccaaccaaatttacggattatttttaattgtaagtattatagcggttgcttatgtaaatactaggaacataaaccctgcatacaagctgggttgggcaatagttataatggctttcccaatgtttggtataatgttttacttctttgtcggtaacaaaaaacctgcaagaaaacttataaaaaaattaaacagatctcaagtttttacacaaagaatgttaaaccaagatacttcaattatcgaagaaataataaacgatgatccttatggtgccggaaacattatgtatatagaaaactacggcccatatcctatttacaaaaacaccaaaacaaacttttttaaattaggtgaagaagcctttgaagatatgcttattgaaataaagaaagcaaaaaaatatattttcattgaatattttattgttcatgaaggcaagatgtggaattctattttggatatacttgaacaaaaagttaaagaaggtgtagatgtaagatttatttatgatgatataggttctgttacggtattgccggcaaaatacaaaagaatacttgaaaagaaaggcattaagacaatagcttttaatccatttgttcctttcttgtctatggtaatgaataatcgtgaccatagaaaaataatggtaattgacggaaaagtcggatatacgggaggaataaatttatctgacgaatatataaatgaaatcgaaagatttggtcattggaaagacaatgcaattaaacttgaaggtgaagccgtttggagttttacaatgatgtttcttgaaatgtggaacggactaagacctaccgacaacgagcttgaatatgaaaaattcaaacctgattacaattttgcaaaagaatactcaaatgaaggttacgttcaaccatacagcgactcccctcttgacaatgaaattttatcagaaaatatatatatcaacattttaaatgcagcaaaagattatgtctatatctacacgccatatttaattatagacaatgaaatgaccactgcgctaattcttgcagcaaaaagaggtgtagatgtaagaatcgtaattccgggaatacccgataaaaaaaatgctttcgaacttacaaaatcattttgtccggaacttattgaaaacggagttaaagtttatcattatacaccaggatttattcatggaaaatgcttcctatctgatgataaagttgcaactgtaggaacggcaaatatggattacagaagcctttatttacattttgagtgtggtgtgtacttatataaaacaaacagtataaaagaaataaaaaaagatatgcttcaaacttttgaagtaagtacaaaaagatacaacaaaaaaacaaaacttccgtttttatttagattatacagaagtttacttagattatttgcaccgttaatgtaataaaaagaaaggaataacaaaatatgaaatttgcatttttaataatgggtaattttaattcaaaaaatgacacagcatacatccatgatggagatgcaagaataattggagtttctaatttaaaagaagcttgtatcattgcaaaaaaactttacgaagaaggaataaactgtattgaactgtgcggagcttttaacgaagaaggcgcaagagaaataattaaagcaacaaataatgaaattccaattgggtatgtaactcaccttaaggaacaagaagaaatttacaataaaacatttaataaataaaaaaaggaccatcttaaagatggtcttttttattatttaatttttcatataaactatttaagtgagcctttaccagcacaaccaaatacttgcattttgtgagcaaccatatctttaacagctgttcttgcaggagctaagtatcctcttgggtcgaatacttctggttgttcaacaaatacttttctgatagcagctgtcattgctaaacgaatatctgtatcaacgttgattttagcaacaccaagtttagcagcttttgctaacatttcttcaggaacaccttgagctccagggatttttgcaccatatttgttgttaagttcaacaaattcttgaggtacagaagaagcaccgtgaagtacgattgggaagtttggaataagttcacaaactttttcaagtcttgcatagtctaagcttggttctccactgaatttgtaagcaccatgagaagtaccgatagcgattgctaaagagtcaacacctgttttagctacgaattcagcagcttcttcaggatctgtgtaagtagcatcttttgcagcaactttaacagcatcttcaacacctgctaatttaccaagttcagcttcaactgttacgccatgatcatgagcgtattcaacaacttgttttgtaatttcaacgtttttgtcaaaatcatatttacttgcatcgatcattactgatgtgaatccatcatcaatacaagatttacaaatttcaaagctatcaccatggtcaagatgtaatacaacatcaacacctgtgtctttgattgcagcatcaactaaagatgttaagtaagctgattttgcatattttctagcacctgctgatacttgtaaaattacaggagcattttcttgttgtgcagcttcaacgataccttggataatttccatgttgtttacattgaaagcacctactgcatattttccttcttttgctttttgtaaaatttctttacttgagattaaagccattattgttctcctttgttttctttttttactattttttttacttccgcttccagttgtttttctaaaagaagaagttgtagggtgtcatctttttcagataacttattaaatattttaacatatttattccctaattccaaataccccatcttatttagataggatatatattgacttgtcattaatgtggcatttttacttgccataaatactttttgagcatgcattacttcatcacgtattgcactcatttccttatctaactcttcaactttttttgctgctgctttcagtctgttggaaagctcctttggtatatccccctcatatttataattaagggaatgttctatggtagcccaaaagttgatagctaaagttcttatttgtatttcacatagaatatccttaaccccaaatgctgtattaacatgatattctataattaaatgaacggaacgataaccgctttctttcggatttgcaaggtagtctttttttataaccaccttcatatcattccttttcattatatcactgacaacctttgttatatcttcttcaaattggcatattattcttacacctgcaacatcggttatctttgttgaaatatcattaatattataatgatttttttctaatttttccagtatgctttttactttttttactcttccgtgaacttcttcaatttctgaatactgaccaactgttatcttttgatctcttattgttttaaattttaaaacaagttcgtcaacagcttgcctatacggatataaaaagtcatcccaattcacgcctgtttcaagcacaatatcattcctttatttaaacttatcaagcaaacctttgttatatatattatattttttcccttgataagtattttgttttttcatctcatccagaatcatatcctgtattacccagtgagatctatcccagtttaaaaagaggacatcttcttcttttggtactctggataccagtctttccactgcaatattttcatccaagttttctaaaaataaaactactctccttacataatcttcgattgaaagcatttttatttttccatctaaatacattttacccaaaattgtatttctttctacatataatgaatgaattttaacactatctgtttttaaaatactaagaatttttgcagcttctattatatcttcatcgctgtcatagggtattgaagcaattatatgcgtacttacttcaaaaccataactttttatcattaaaacagctttaatataatcagctaaagtatgtcctctatttaattttctaagtgtttcgttgtttacggactgtaaaccaagttcaattattatatcaagatgatacttattttctacttctttcaaaaagctcaaataatcattatcaatacagtcgggtcttgttgaaatagacaccgcaacaacattatctaatacatttacagcttccaaaatgttatctttaaaagtagaaagtttaatatacgtattggtaaaattttgaaaatataatataaatttttcggctttatatttatttacaaaaatatctaaattatcgtttatttgtttagtaattgattctttgcagtcaccattttcataacctgcacctttttcaccacaaaatatacatccgcctttagatatactcccatctcttaccggacaggttgtgtcaatacttataggaatcttataaacttttccttggtacttttcttttaacttagtagaaaatttagtatacaatgttacgcttcttgatattcatatttttttagtaaatttaattcatcttcatctcttgcgccaagagtaagagttatatcacattcatactcttttgtaagagcttccaattgatctaaaaatgctattgcagtttcaagatgtttagcatttaaaatttctaaaatatcatcaatgtatatttggttaatatcatagtttccggctattaaaccacataaaaatccgaaaaacatttcaggagatgctacatgaaattcagatgtgttaataaatctgatttgtgtcattacttctcttgaatggttaagtgaagaatcaatataaacttgaagtccttttgcttctttgttttcactgttagctaattcaataagtttttgtgtttttccagtgccttcagcaccaccgataattctaaccattttaatcacctcgtacgtcattttttattttaatttattatacaacattttaatcaaaatgtgaagagcatttgtaacacaaattaatttactgccttatataaataagcaaataaaaagactatttatatttatatttttcataattttatttttaattcacaaaaaagaaacaataaaaaaagtgcatacgcactttttttattttagtttatttaaactttctcttacttcgttaagtaatgcttcatattttttatatttttctttttcaccttcaactacttttgcgggagctttatctacaaagtttttatttgaaagtttcttatcaagtctttctatttcaccaataagtttattttcttccttttgaagtctttcaatttctttgtctttatctacaagttctcccataggtatatagattttaccgccgcttgacacaacacttaaactttcttctttgtcatattcgctatcaataaaacttatatctttaaagcctgcaagtttacataatatatctttacttgatgcaaaaacattttccatgtctttatcatttgcaaaaatataaccgtcagttttctttgaaggtggtatgttcatattagctctcgcatttcttacagctcttaaagcttcaacaataatgcttatatcattttcttcttttgagaaattatattcttctctatattcaggatatttttctccaataaccattccgttctttcctggcatgaaagagtaaatatgttctgtaatgaaaggcatatatggatgtaacattttgattatatccataaatacatggtttagagtatactgtgtattaaatctgtcatttacattttcagaatttaatcttggttttgcaaattcaatgtataagtcacagaattcattccaaataaatgtatatagtttttctgctgcaataccaaattcatatttttcaatatttgcagtaacttctttaacaatttgattctttcttgaaattatccatttatctgtatcatgaagtgtatcaaaatcaacttctttttctacgtcaaaatcttcaaggttcataagaataaatcttgcggcattgttaattttatttgcaaagtttctgtttgcttcaactttactttcttgccatcttgtatcatttccggctttatttcctgttacaagagagaaacgaagtacatctgcaccatatttatctattacttcaagtggatcaataccatttccaagagatttactcatttttctgccttgtgaatctctaaccaaaccatgaatatatacatgatggaaaggtggtttacccatttgttctattccggaaaataccattcttgctacccagaagaaaataatatcaaaacctgttaccaaaacatcatttggatagaatttttcaaggtctttggtattttcaggccagcctaaagtagaaaatggccataaagcagaagagaaccatgtatcaagtgcatcttcatcttgttttaatttagagcatccacattttggacatttttcaggtgcatttttgcttactaccatttcaccacattcttcacagtaatatgcaggaattctatgtccccaccataactgtcttgaaatacaccagtctttaatattttccatccaattaaagtatatctttttaaatctgtcaggaacaaattgtacttcggcatttttaacaacgtcaatagcaggtttagcaagtggttccatttttacaaaccattgaagtgaagttaaaggctcaactgttgttccacatctgtaacatgttccaacattatgcatatgatcttctattttttctaataaaccggcttcttttaaatcttctacaatttgttttcttgcttccttagttgttaaaccttgatattttcccccaagttcatttattgttccgtcatcattaaatactcttatttgttcaagattatgtcttaagcctacttcaaagtcgttagggtcatgacaaggtgtaatttttacacaacctgtaccaaattctttatctacataatcatcaaatacaataggaatttctttgtttacaagaggtaaaatcaaagttttacctttaaggtgagtatatctttcatcatcgggattaatcgcaacagcactatcccctaacattgtttcaggtcttgttgttgcaattacaacatactcatcactatctttaataggatattttatatgccataaatgacctttttgttcttcatattcaacttctgcgtcacttaaagcagttctacagcttggacaccagtttattattctgtttcctctatatattaagcctttttcataaagtcttacgaaagtttcttttacggcttcgcttacaccttcatccatagtaaatctttctcttgaccaatcacatgaagcaccaagttttcttacttgatttgctatttcttttctgtaagttttggcccagtcccaagcttcttctaggaatgcttccctgcctaaatcttgttttgtttttcctgtctcttccttgattttatcaacaacctttacttctgttgcaatactcgcatgatcttcaccaggcagccataatgcggcaaaacctttcattcttttatatcttataagaatgtcttgtaaagtatcatcaaaagcatgccctatatgaagttttccggtaatgttaggaggaggcataattatggtaaaaggctttccgtctttgtttatttccggtttaaaatatccacctttttcccatttttcatatatttccccttctatttttgaagggttatattgtttttccaatgttttatcactcattttacaacctcatttttttatttattaagctccaaaaacttttataaatgtagccattattaccattagtcccataggaatggcaaataaagccaatattttaaaatatctttcatcagggtctacatgatcaagacgtcttacgaaaaaagcgcctaaacaaaccatcaaaacaccgattaatctaactatccatattttcattttgacacctctaaaaatttacaaattataaaatttatgataacaaatatagctttttttgtcaatgaattagccctatagaccttataaacattacacattaaacaaaaataaaatatagaaaataaatatgtaaaatataattaaattttataaaaaaaagacttcaaacttatgaagtcttctcattaatcgtcaaactcttttgaataattgtaatcaacttttattaattttccaccaagtttctttttgttaagtttatccttaacatataaatacgttccaaaggctccaattatcattacagaaccaactacagatgctaaaataatttttccggtattgttcttttccattgttcgatcctctcttaaaatttatattataattatacatcacataagataaaaattcaaacatttaatccaattctaatactaatttaagagtagttatccccaaaaaagtagctatatcatctatatttttaattcttttcactttaatttccattggttcatattcttttaaaaatacagatgaaaaacttctttgtacacatacaataggcttatcattttccatttcgtcaatactggaaacattaactgtagatttttcatcaagaccatatgatattgtttttatattaaaatgccttatatttatattactggcagaattaactattaatatatcagacaagtttaaagctttgcacaaatttagtattttatccttttttgatattttatctaccaacgttatcttaaactttacatttttactatctttacaaaaatgttcatgttctaatatattttttaatgatatttttttatccataaaagaataaacctttattctttccccgttaagttcaatacataattcttccaaatcaattctcctgattttaataatattatcttttcaattatgtacgtttattattcaaaaaaataaaaaaaccatatcaaaagatatggtaaatgggcaaaaaaatggtgacccatcggagattcgaactccggacaccttgattaaaagtcaagtgctctgccaactgagctaatgggtcacttaatatttgacagcttaattagtatactaaaacattataaatttgtcaatactaaattttaaatttatttatataattttcaatcacttttgacaaaaaaatggtgacccatcggagattcgaactccggacaccttgattaaaagtcaagtgctctgccaactgagctaatgggtcacttaattaatctgacagcttaattagtatactaaaacatacaaatattgtcaatacttttttattttttttataaaatttttatttatatatattattttactaaaatgtcgagttttattcatatatttattatcttttaagaatccctgttattttgtacatttaagcattatatgacttctctcattaaaacattttatttattattaatttataaaaaagtttataaacctatggaaatcaaaataataattattataatttatataaataaaaggagaaagatatgaattatttaaaatatagagaacataagggaaaagaatattttgattttccaaatgactactgcgtaatcgatattgaaaccacagggcttgactctgaatataatgaaataatagaaataggtgcacttaaaataagagcaactaagataagtgatgaattttcaattttggtaaaacctcaaaaagaaactatttctgaacaaatacaagagctaacaggtattgataacgaaatgattaaagatgctgctaacataaaagatgcaatacttaagtttaatgatttcgttggaaaagatattttagtcggacaaaacgttaattttgatataaatttcttatatgataattatgaaaaaaatacaaatttttatcttagtaatgattatgtagacttacttaaaatatcaagaaaaataagtcctgaatttgaaaatcataaacttgaaacaatactaaaaaaattaaatatacaaagagaccaaaagcatagagccttatctgactgtatagacacatatcactgttttgaaaaatacagaaatattattttagaacaatatggtgatataaatatgtataaaatgatttttaacttataaaaaagaacatacatatgtatgttcttttatttataaatttactttttaaaaataatcgttaatattattgtttacatcattcatatcgctcatcgcatcggaaaataattcatccatagcagaattcatattatctatattccaaacaccatcttctttactcataataaaagtaacagttttttcaacagaagtgtctttttgtgcagcatcgtttatttcatttgtaaaattatccattattttatttgttatatcacttgttgaagccgataaattatttttaaaccatgaaatggtgtctttaactgcttgctcatagatgtttccaaaatcaaccatatagaatgtaacttttcctgtagccgtatctccgttttcttcaacacttactactttataatcaagatttttataaagagccaacataaattcatctaaaccacttgatttaaaatattggaaatcatctcctaaaaattctttataatcttcatcaacttcttccccgtttatatatttttccaatactttatcttcatccttacagcacataacatccaagtacgatgttaaagactcctctgcacttggtcctccacaacctgtaaatccgaacataataaaaatcgccataattagtgccattatctttttcataatttccaccttctttcttatactttaattgtaaatattataacacaataaatttaaacgttaccaaattatattatttttttacaaatatttataatattttatatttttataaagttttttcctttttatgttacaattataaaaacgtctacaggggtataaaaatgataaataatgtaataaaagttatagaagattatttaaataaaaaaacagaaaaaaatattttcaaaaataaaatacacaaactaatagacaaaaatcaagaaacattatacaaagaagatgaagaaattgcggatttaataacatacgaacttatagaaatatgcaacaaagacattgaagacgatgataaattcaaagaagaaataagtgcaatatttgaagaaataaaaatcataatagaattataaaaagagaatgcaataacattctcttttttactcatacaaacttccaccgataaattcttttaacaatgataccccgggaataaactcttcagattgtatctctttaaacaaagataaaaaatcaataaggtgttttgcttcgtaataatatttattattttgttttatctgtgataaaagaggaagagcatattttttaagtacaggaatttcataaattaaagttgaattaattatataatcagcctcttctctataaggaacaatgtttatcttttctccttcccttacatcttcccacatgcttatagtatcacaagcactgttacctctaaaatgtgcatctcttacaattcttcttaacattcttatttttgatgttgtaatcctattatattggtctattcccataactgttaacggtgcaatatatattttaaattttttgctttctacaatatctaaggtaagacgttcattaagtccatgaataccctcaataataattggattatgctcgtcaacttttatttttcttccaatttttcttcttttcccgcttttaaaatcaaatacaggtatactaacctcttctccccttataagtcttattaaatgttcattaaataaagggatatcaattgcttctattgattcataaagaggtttaccctcttcatctcttggtgtaaattctctatctaaaaaataatcatcaagtcctattgtaacaggacttaagcctcttgccataagatgcgttttaagcctttttgaagtggttgttttacctgaagaagatggtcctgctattaatataattcttttttcattttttgaagtaataattttatcggcagctttagcaattaaatattcgtgtcttgcctcacttgccaaaataagttcttcgcattctccgtcttctatctttttatttaaagatgcaatatttattacattaacatcttttaaccatttatcaaatgcttcatactccttaaataatttaggattatcataaaatttatgaagcttattaggatgaagtttatcgcatccaagcaaaactgccccatgattgtattttattatatcaaaaaccttcaaatatcccgtagatggtaataaatcaccatagaaatacccataacaatcacctaactcatacaaggtcaaaagacttttatcatccaaatagtcaacgacttctttatttgttaaaaaaatatttttatttattgattctttcatttcctcttttgtagtttttaatttcacaataggaagatttaaatctataaattctctcattttttcttttagctttaaaatatcatcttcagataaatcactttcatctttatattcaaaaaaaataccgcctccaatagaatatcctatggaaacctctctacttttaaaaactttttttgagcttacagcaagtaaaaacagtaaagttttttcataaatttttttacctaaaaacgtgttaagataaacaaaattaaaatcacaatcttctttaaaatgataattcaaactttcaacttcattattaacaagaccccccacaatcaagtcttttttttcacttaaactagcaaggtctttaatggttatgtcttcttttatatttaaaatttttttattatcaaattttatccttatcatatcacttctcctttaactgcaaatatttgcttattccttcaagataatgaataggatatttatgatctaaatataccttcaattccttattaaacgcatcatagggtatagattttcttccaccattcattgcattattataatactttattagggtttttatatctaaaataaaatattcatcaaaaattttaaaatggacaagtaagaatgcaatgccgccttgcatatcaaacttatccataaatttcacttgatgttcatgtatatttgcaatgggaagacttttcccagatatttcttttgcatcgaagcaaacaggtataccttgaatattacctatataatcaactgtacttttttcatcaaaataagcaagagatattacgcctcgttcattatcaagcctaacaggctttattgccgtaggaatcttttgaacgacagccaaatcatcatcaaaatatatcttattggttctgtttattaaatcctcgaattcgcttcctcgaagacctctgctttcccagtaccccattttctctccttgttaattataatttttcgttatttcttctttttactcttatattctttctttctttttttctcttcttatattttttctgcttataaatatatacccctaaagacacaaaaacagctaaaattagtatcccgccaataaaatatgaaaatacaattgcagtattattcgtactatcctcttgattttgtacttgtgtattttcagtattttgtgtatttgaagttgtagttttttcttcttgtttagttatagttgtaagttctgtttgtgttggaatatatacatcagttatctcataagactcaattattttatttattgtagatttattttctgacatatcagccatatatgaatctatttgtagaatataaagccccccattattaacagtaagataatattcaccttcactttttacgcttttgccttcataagagcatttccatgcaggtatcccgctaatggtagttttacttatcttataattataactgcttttagcatcgtctaatatatctttaaaataattatttatataatcttcactattccaagtatcttttacaaaatcactttctatataaacttgttttctaagtaactctttattagataatttattactttttaaaacctcctcatatacatcaccatatgaaattctaaccgttaaattaaaatttacaggaaattctcttgcattttcacttattttttccatatcactttttgcagaagaaggaattttaaaactcatatgtaaatcttcatttgaataggaaacaaatttttctgcacctaaaatatatggtgttactatacttaatatcataaaaaaaactaacaagcctacaattattcttgcaattaattgtctggttttagatttcatattaccctcctaatagatactattgataatgatatcatatttatttttttttatcaataatatcaatattgattaatatatagaataaatcatataataaaaagcaataattttaaatataaacaatatattttttttaattttcagtttaaattcaatttttgttttagataattttaaatttagttttccctaaacaaatttctaacaaatcaatctttcccaataaaacaaaaaagctacaatcctttaaataaaaggactgtagctatgtaaaaagaaattatggattttattcccaaggtttcaaaacaactttaatagcttcacctgttttaactaagtcgataccttttttgatatctcttaaaggaataacgtgtgtgataaatttagtagcatcaattttacctgttgtgataagttcgatagcttttctaaatactgatggagcataagcatatccaccgtataatactaattcttggtagtgaattaagttagagtcaaaagctacgtggcagttatcttttggtagaccaccgaataaaataacttttcctcttggttttaataaatgagtagcttcaacttgaacagaacctactgggcaagctgtaataacaacgtctgcaccgataccatctgtttcttgcataacgaaatcatgtaaatcacctgcaactgggtttacgaaatcatcagttgttgagaatcttgttgccatatcaagtctatgttcgcttggttctgaaataataacttttttagctcctcttgcttttgcaactgcactatgtaagtttcctaaaggaccggcaccgataacaacaacaacatcgccttctttaacattagcaaaatcttgtgtagagtaaacacttgataatgtttcagctaaaggaattaagtctaagttaaatccttctggaacttctacgataccatcatctgtacaacaatcagctgggattggaacgtattgagcatatccaccaggcatttctgaacctaaaagttttttgttgatacaatggttttgtaaaccatttttacagaaataacattcaccgcaaagtttgataagtggatttagaactactctttctcctgctggatatttttcattatcacttttttcaataacacctgcaacttcatgacctaaaatatgaggaggtgtaacatctttatgaccagaaccaaatgttctaatatctgatccacaaagacctactgcttcaacctttactaaaataccaccttctggacattcaggtgtttcaacgttttctaaaccaaaatcatttggtcctctaaatacgactgcttccattataatattctccttaaaattaatttttttatttgttttattttttttgttgaattgattataacacaaagtcaagcagaataaaatatataaattaaaacttttgtaacttgataaggtttacattttaattttttaattttagcatgttacaaatgtcacattttgcattttttaaggaggtaaataaaataaatgttaaaaaaaatctggtatttccttattctattttcggtaatatttggaatttttacaggtaaaacagaaaatatcgcaaatgcattttcaagtgcaggacaagattgcgtaaaaatatgtttttctctaattggaacaatgtgtttttggagtggaatgatggaaataataacaaaaagcaaattaacagataaaataaatactgttttcaatccacttatcaatctattatttaatgacataaagaaagataaagaagcttcaaatgccgttattttaaacctttccgcaaattttttaggtcttggcaatgctgccacacctcttggaatagatgcaatacacaaaatgaataaacttaatacaaaaaaagataccctaagcgatgatatgattatgttcttgattttaaacacaacatgcctacaacttctcccaacctctatatttgcttatagaatttcatttggctcaaaaaatccaaccatagtatttcttcctattttgatttcaacactatttacaactattatcggtattgttcttgcgaaattatttaaaagaggcagaaaatgttaaatttcatatcttcttttgtaattatttcaataattttaggtgttttaacctatggaatggtaaaaaatattgatatttatgcgacatttgtaataggtgcaaaaaaggggctaaaaaccactttaaacatttttccgttccttttgacattcataataagcgtaaatatttttaaagaaagcgggctaagcgattttttaatttctattctttcccctatttgcaatatattccattttaaaagtgagttactacctttgatgatatttagaccaatttcaggctcaggagccagtgcaattctttgcgatatatttaaagtatacactcccgattcttttatcggacttaccgcaagtataatgatgggttctactgaaacaactttatatgttttaaatgtatatttgtcaaatgaaaaaataataaatctaagatatgcacttaaagcatgtcttcttgcggatttttttggatttttaatggcttatattatatctttattgttttttacataaatatttttttagtttttttaaagaaaattaacaacatattaacaaaaattaacattctcttaagttacgtttttaaggctttttttatgatatattgtgtttaaagaaattaaaaattaaattacatatcatataaaaagagagggaaaaaatgaatacattaattttaacagctcgcttcggaatgggacatatatccgcagcaaaggcaatagaggaagaacttaaattaaaaaataataattccaatgtttacattgttgatgtagtagattatcttttcccatcatgggcaaatttaatttactcaggattcaatcatcttacaagcaagttttcaacagtatataacttttttaataaaacagcgggaaattataatgaaacaataccattaaaaaaagcgcttgttaaaaaattagatagattaatagaagaatataatgcagatgtaattatctcaacaataccaattgcatcaaaatatatatctttatataaagaaacaaaaaatataaatatacctttatatacatatataacagatatatcagcacataacgaatggttaggcaaaggaacaaatttatattttgtgggaagtaaagaaactaaaatcgaattaattggaaaaggtgttgaagaagaaaaaatactaatttccggtatacctgtaaaacaatcattcaaaaacctaaaaataattaaaggaaaaaaacaaaaagaattattaattatgggtggcggacttggattaatacctggaatagaagatattttaaaaacttttaacgaaaacgactctatcaatgtcacattaatatgcggaaaaaataaagaaatgtttaataagatgaaagaaaaatttcctaatattaatgtagtgggatttacaaatgatgttcataaatatatgaataaagctgacctaataataacaaaatcaggtggaataacaacatttgaagcaattcatgcactttgtcctttatatataatacatcctttcttaatgcaagaagttggaaatgctttatatatagaaaaaaataatattggaatgatcaaatggaagaaaaaagaaaacatatcaaaagatgtaatagagttaatcaatgatgaaaaaagattaaatcaaatgaaagaaaacatgagaagaataaaaaatgaaactcaaaacgattatttagaaactattatatctgcttaaaggtgaaagacatatgaaaattttattttatattatattaatatttatatcattaattattttatacggaataattccaacttatgtttataagataaaacataaaatagaaaaaaagaatataacaaataatggtaaaaacatataccttacattcgatgacggcccagatccaaaatatactttggaacttcttgatatattaaaagaaaatgacatcaaagcatccttttttgtggtaggtgaatttgcaaaaaataattctgacataataaaaagaatgcaagaagaagggcataaaataggacttcattggtatgaacataaaagcgcactcatacaacatcctctaaaaaccaaaacgaactttcaaaaaggaataaataccttaaataatctaggcgtaaaagacccaagtttcagacctccctggggacaattcaactgggtaatgatataccttatgaagtcctataatttaaaacctttcctttgggatgtcatggcagaagattggcaaaaaaacacgacaagtgaaataataaaaaacaaacttgaaaaaagagtaaaaaacaatgatattatatgtctccatgacggacgcggcagagatgatgctccaaaaagaacaattgaagcattaaaagaaattcttccaaaatggaaaaatgaaggatacatttttaaaacaaccggagaataaaatgaaggataataaaataaaaaatatttttaaatctacaatattttttgtagtaatgcttattcttacgtcttatatgttgtttaaagattcaaatttaacatctataattgagactattgaagacgtaaatacaaactatatactacttgccattatggcgatgtgtgtatttataacctgtgaaggaataaacatacttagaaatttaaatatactgggatataatgtaggacttataaaaggaataaaatatgcccttgtaggctttttctttagttcaattaccccatcagcatcaggtggacaacctatgcaggtttattttatgaaaaaagataacatagaaatatcacacagtatagtagctttacttatagaacttgcaagttttcaaatcaatactgtaattatttctcttcttggttttttccttaatatgaatttctttatggaaaaaataggaagcataaaatatcttttatttataggaattacaataaacataattgcatttttatttatattatgtgcactttttaatagaagattaatggagaaattattaaattttgcaacaaaaattttaacaaaactaaaatacaaaaatattgaaggatttaaagaaaaatcaaaagaacaacttgaagaatacgcaagcggtgcaaaatacataaaaaacaacaaaaaagcacttataaaaactttaatgattacatttatacaactaacagcaatgtattctgtaacattctttgtatataaatcttttggactttcacagtttaattttatacaaataatatcaatacaagctgtactttattcatctgttatggctcttccattaccgggtggagtgggtgcaagtgaaggaggatttttatcactattcaaatacattttccctcttacacttacaagccctgcaatgttactttcaagagggataaacttctacttattcgttcttgtttcaggactggcaataatgttttttcaacttatttatattaaaaactccaacatgagcaaggaaaccgcataagggtttccttgatttttttactaatttgacatttttttttctatttcttttattctaatctgtttttttattgcttcattatcaagagaattaatatctttatcaaaagctattccaagccttgagcaacgctcatattgtttaacttgattatcatattcaacaaaccactcataaatactatttaattcattaaaaagttcttctttgtttactttttcttttattttacttaaatctttaactaaaatattattatcaagataataagcataatagaattcatcaaaatctgaaggaatttctccgttaaacgcaacaccaccatctattcctccaagtgtagaaaatcctacaacataattattatcatcatattttatttccatcatctatatcaccccataaatttctgaaattactatattatttacataagcatgtgaacttgcattatgacctgttgacctcgcataaactacatttattatatgaccgctcccactttcacttatagttgaaccaaaatggtaagttacggaagaaggtgaatctgaagcatacccaccgatacctcttaagtaagaaccttttcttatacctaatatggcagtaccatagtcttttaatactatcatatataatctatatcttgtgagtcctgttattacacctgttttttgtccagaagttatactacctttaaataaagctgttatacttgttgtaagttctttacttccataaaaaataggtttattgaatacaaattttttattttgatcatcataatacattactgaaacatcttctatagcatctttaataccaaaacccgtattactatccccatttccaccatataatgccatatgatgtttattttgtgcaatatcagcattattaaaatgcaaatatcttacatttgcagttcttttatcaccacccatatatacattatttgataaatatgtagttgcaagccctacatcaaaattatcttcaacttccgaactttttcctattgcaacaccttttccacctgattttaaatcaacagtaacaaattcagtctttaaaataaaaggaacttccatagaagacgcaaagtcattaaaaatagctctaataataaaagttttatttggagaaaaatccccatattcttttggtatattaatatttattactgaattactgctatcaactacaacattcttttgcactccttcaactataccattatctttattactatctcctattgacacctcacctttaaaaaactcaatatctttttcttcgtttggtgttttggaatataatatataattaattttattcttattaccaaccgatgcaaaatcagcattaaaacttacaataagagaattaccactactctcttcagctctttttacattaaaattggaaatatttaaattgctgtaaggatatacagctattgttgagtttaaagctgtactttcataccctctgctgtctacaacgctggttaaaatttttattccttccccactacttggaagtgcaatcccttttatatgtgaagaagttgaagaataagctttccctccaacattaaccttatatgtctttatcgtagaattattttttccaacagccgttattaaagaatcaatagtactaacattttgaaccaaaagaccttcaagagtactattacctgttatctcattacttgaaacggtaggcttaaatgtatcagtatttggaacttttacagttaaattaacatacttacttcctatatttgtactaccattgtatgtagtacatgttattttcattgttgccgaagtagccgaagtaatataatctgccaaagaagtatctaaacttaaagatgtgctgcttccaacattacttatagtctttgaataacttcccattgcacatactattttatgcgtaaaagaactactctttctatttgtataaattgtaacactacttcctacatttactgatgatgcactaagtgtaggagtagaagctcttgggatagtcgcaagtttataacttcccgataaacttcctgttccaagacttatacccgttggatgagatgcactaaccgatacggtctttgttccatctgcgttatgtgctatcgtttttgttacagaaaataatttattataagttcctgttcccttacttctaaaatcaaaacttacggattttgtatatttaactccgttaattttataagtaaatgtttgagagtttaaattgtaactttgagagttagcgcttgctttatacattccaaaagtaaaagtaacacttgaactgttgtttgtaacactttgagagtttgtagaacaagttacatataaatcataactacttgaagcataatttccttttattgttgccattattcttctcctccttgtaaatatgttattgtgagatttccttcgcttccgtcaaacatgaaatctcctattcttaaatttttatttatatttgccattgaagtttcaagccccattgtatttatcttagttgaaacattttctccaaccttaaaatcaatatttccgtttgctaaatatatactcgctcctgtttgagtttcttctaaagaatcagtattttcaccatctaaattagtttctgttaaagagaaactttgaacaacaggattattttcttttacttcatcgcttgattcaacatttatccattttgcatttatcccaacagtacttatgtaatttgcaataaacgaaccttcatcacttaaaccaaaggaccaaatcggctcttcatcgttgtaattatttgtccatctaaaaccattccccgaaagttcatatacaatattactttcttttaatgtttctttattgtgataataataaacaacactgccgtcatcatatcgtttagatgtagaataaagcccaagcattgctcctggtattttatttaaagcaagtatgtctttttctctttttgaaagctcttttttaagttcttccttaacattgcttattatgttagattcatgctttgtaagaggatttgctgaagcataactagctttttgctctgttgtcccctttgcttcaatttcagaagagccattcaaattaaaagtatggtgtgtaacaatactttcaaacccattgcccatattatctgtaaaaactatttttgcaagaggccataaaaacggaagtgatatcgttgtagctttaaaaggtagatagtttattactttcatattagaaagaccatttataaccttgtttacatatgtttcatcatatgatattacctcttcttcatcatctgtaaaatctaatgagccatcttcaccaccagaaacatcaccctcatctggtgtatcttctttgttttcaaatatttcaggtgatgtaataagctcatttccctcaatagtataagaaagaagagtattaacactttcatctcctttgttttcttcaccttcaatctcacttgtatcagatggtaaagtatattcatttgtaagcttaacttcttttgttacattaccgtctttactgtttacaacaagtttatttaatgtaagagatgtgtttgagtattctgatgaatatctgatatttggcgtaatattaaaaacttctgttgtatttggcacaaagaaataatcatagaattctaatttcaaattcccctctgcatccatatatgcacaacttcctgttatctcacaaatccattgtaaaatctgtctacaggttatttcttctccctccggataagaacttgggacataatcaagattaggtaaatcaagatttataaaatattcatcaggtgaaatatcatttacgcattttgaaaaaatagcataaagtatctgcctaatgttcatacctttaggatatatggaaaaatcaaatactttatcaaaagccaccaaaccgtcaagagcagtaagttctacggttgtttgatttttaacctgttcatctaccataaatacacccattggaatatatgaaataagcccgtcatctgttttaacttttaaccttacataaagttttgcaccgttaaaatcaacatcatcaaaatttcctttgtggttatccaaagtcatttttaattctgccgctatggcactgccaatttctatgttatccccacttgcaacatatctatcaatagaaaaagaacctgcaataatatttttttctgttatattcattgaagtttcttcattttttacagtttcttcagtaagtaattctgtattaccattttcggaagtatctatcggtggtaaattaactgccgatgaaaaaaagacagagatatcaactccctgtcttgtattttccattactttatcaaatgttttcctatcaattttatatgacatctttaaacctcctcacttggaacttcaccattatcttcgttttcaacctcttcaaaatctgtattggcttttctttgagatagtgtaagagaaaagccatcccaaaatccaagtgcaccattataaagaggcacgcttgtttcaccaagataaaattcatctattaaatatgcgtttttctttggatcaaaataacatattgttacatattcatccgaaaaattattaagaacaatgcttaagtcgttactgctcattgccctgtatgaaaccgataattcaacatattcaccaagcttcattttattataagtagtatcttccgttcttccgctgtcagaagataaaagctcttttaatgcacaactgtaagatgaagggcaaacctgtaaatcaatgtattttatcattttaacgccttctttatcgtacgtatcaactattaaaaaaggaaggggattttttatcttttcaagcccttcctttatataattattaaattcttcatatgttttttcaattataactttttccatttttatacccccaatgcaataatagttttaccgtctcttctgtttcttctttcgatagctgtaataatatcttgagatttcactctgccgttattatcaactatttgaattgtccaatctcctccgaccatatttgagccaaaagcagcgcttacagcagaatatacaccttttgaaacagatgcaacaatttggtcattgttcatgacagctgtttttccgttaaatgagcctacaagttcaggtcctgcctctcttgctataaacatttgtcccgcatcaacaataccgccttttgcaagtcttggtaaagaaactcttgctattacgggaatttctaccccaggtattttatttattaatctgattgctccatttatggcaccgataaacccattaataataccgcttgcaaaacttataactgcattaaccacagacttaaaagctcctgatattccattacctattgcagtaccaattttactgaacatgctttttatattgctccagatattgctaaaaaactttacacatccggaaaatgcgtttttaattccattccaagcacttttaaatatgcttccaaaccatgagccgacttttgaaaatacattctttattccactccatacgttcgagaaaaactcaccaacaaaggaaaatgcatttttaattgcttcccagcctgttgagaatacatttccaaagaattcagccacaacagagaaaataccgcagataacttcccatgccatggagaagattgaacctacaaactcaagcccagcagagaatataccgcatataccttcccataatgaacttaaacctttttgaatcatttctccgttacctgtaaataatccaacaattatatcaaaaacaccttttacaatttcaacggctcctgaaattaattctgaaataaaatcaaaaaatcctgttacatattctgttatcattggtccatattcttcccataattcaattaatacatcaaaaagtccaacaataatttcagatattaatccaactgcttctgtaatagactctattagcccttcaattccggaacaaaccccctctacaaatggagtcatttcgtctccttctccaccaaatatagcttctttaaactccgtaaaggctaatattgcaggctcaaaagcatctttaacaccattccatgccgttgtaattttatctctaaactcttcattagacttcattagttctttaaatatagcaataagagaaacaactgttgcaacaatcaaggcaatagcagcaactatccctcctgacaaaagagaacccgccatggaaccaatcttacttgcatttgctgtaagtgcatttcctgctgcgctcattttatctgatactaaatttggaagcccctttattccgtctttaatgcttttaaaactaacattagatattgattctttaaatccttttatgttttctacagaatcatttccaaaatctttaattttttctttaaacgacaaaaaattatttttccctttacttacaaaatccgaaaatgatactttactgttatttaattctcctttaaaatcttttaaatattttccggctttaattgttccgtctgatactgcatttgaaaaagattttatagcctcactcttatttacacttgaatataaatcttttattgtattttttatacttttaaccgcattaataccttctgatacagaagttacaatgtctcccatacctccaataaaagatccaaaacttaccaaacaattatccacggctcccgttaatactcccacattattttgaagctgtgttatattatctgccaatgttgtaatattttttgtcatatttccaatatttttatttgccatttttttctcctttctatttttcattttggctaaaaaaataattatttaatttattctttcaattcaaccaccccctttcaaaattcgtaataaaaaagcaccaaactctcgtttgatgtttttagctaattttatattttataatcctaattcttcaaaactgtattttgaaaatgtttctatatctccgtttttatcaagcatacttatatatttttcttttaataaaggtcttacaattttaaatctatctttttcttttattactaatccagaatcttgtaatattttcattatcacttgctttaattttgctgatgtagattctgttctttctcttaatgtcttacttaatatacacttttcttcataccaattatcaatatcaaatttttcaatatattcttttctcatataaagtttatctttatacacttctattacaaaatctctgactaatttatcagttttcattattgcatataataaaatatacttacttgtttcaatgtctgaacaaacaaattcctctaacatttctttgtccataacttttaatcttctaaatattggggaattaactctttgtatgcttcctgtttttttatgtttaatcaagttttcttcaatattccttttttttagttcttgttcattctccccgtctagtaaataacgccctataatttttgtttcattatataaaaaaggttcccctgttagttttgcactataatcctccatatttcctcctttttcacccgtaaattgacaataaaattatatcatatattcttttatttggaaagtatttgaagaaaaataaaataaatattcgcaagaaaaacaattatttttatgttaaattcgcaaatagatatacacaaataaaaaatataatctatttcccctagaaaaataatatttgcccaagttaatggaataattataatgggtgaagttatatgataattaaaaatttacgagaaagtagagaattaattgataaaaagcaaaaagatatagcagaattgatgaaagttaattttacaacagtatctggttgggaaaccggaaaagatactataccattaaaaagattgatagaatatgcaaattattttaattatagtttagattatttattcggtttgactagaactaatgatacaaactatcttccattaactattaaccttgatttaattgcaaaaaatttaaaattattaagaaaaaaacataatcttactcaagcagatgttgcaaaaaaaataaatactactcaagcctcttatgctcattatgaaaatgctatcaatttaattcctactacatttttatataacctaacacttatttattcttccttttcaattgatgaattattaggtagaaaaaagcaataagtcctattaagatttattgcttttttgtttttctatttttataaattttaactcgttgattattttagggaatgtttctttaactttttcttgcgttaacagttttgtaatatactcatcaaatccataataccctacaaatgtatctctttcattttccgaaactgttaatactataacgggaatattaaaaccttctatttcttttagatggtctagagtatttggaccgtcacaatgtcctctatcataaatattatttgtaataattaaatcatatttttcgccatctttaattctttttacaatttctataccacttttagcaatcgttgtttttattcccatactttctaaaatgtatattgtgtttgatatagaacttttactataatcgccaacaagaacatttatttctttatttggtttatattttgtttttactttaataattggaatcaaatcttttctaacttctttttcccactcaccaacttcatatccacttttttcaatttctatatctagggtatcaaaaaaagtgtttttttgttttgcattatcatcttcttcattatctttattttttacataattgtataattcatatattaaacaaattaaaaataatacaattaaaaatactaatataaatttttcctcgctcatctaattttacctcctataaatttatttaaatttactttatatttttcttttaaaatttcttttgtttttttatatatttcactttttaaacataaacattcgtattgataatcagatccagatgtaatagaagcaaataaatctttatctttgacttcccaaagttcttgtaaataataattttcatagcattcataagcaaaaagtgacgcaaatgcttctactatactttgctttctatttttctttactaattgcatattttcatataatcttttaatttctttataatctgaacttgaaagtagaaattcattaaaattaggattatcaagtatgttataactttttaattcatctcctccatcttttgaactagaagggagtctttttattattgccttaaaacaattatttttttccttttttataaataattctatacaccatatattttcatcaattccaattatgtagccgtcttttttattagtcacatctttcttatcaattataaaactttcttttccgtccgttattgtcacaatgtcactcctctatattattctattttcccaagtaattggtaaaaaaaacacagtacacctaataaataatgtactgccttcattgtgtttatattatagcaccttattttttaaaagtcaacggctatccgtgaataatttctccggttttccgttaaaatattactgaagaaatgaggtgtgtgatatgttattcaaagaagcagtaagtaaaagaatatatgaattatgtaatacttacaattatactcctaacaaattggctgaattatctgctgtcgcaccatctactttacaagatatgttagcattaaaagttaataaaccaaatgcttatgttatttatcaaatatgcaaaacattaaaaattaaattatatgatttttttaatagcgacctttttgataatttagaagattaaaagactattcaatgtatgaatagtcttctttatatattttaataaataaattgtaatttgtattactttttaaatacttttaaaacgaaacctaatcccaaaccaatcatagcaaatacatatcctaacataaaattatcaaaaacaattcctaatgtatttcctataataaatcctccgataattaaccattctattttatcatcattatcattttctatttcaatgccaagtgcgttatcaatagaaaactctaataaaactgctaatttttttaaactatcaatatcaggaatggtttctcctgtttcccatttagaaacagtttgtcttgcaacatttaattgttcagcaagttgttcttgtgtcatatttttttcttttcttttttgtagtattatatcctttaattccaatattcccacctccaatataattttatattataaatatatttcgcaccacctattagaagtggaattttcgcacttcattttaacatttagataaattactatttattaaacaaatcactaaattgtaatttatataaaactttttttcaaaccttttttaaatactaaaattgcttttgctgttcctgtaattgacatagtaactagctcataaccatcttgtaacatttcatttgctttttcttctactttttgtgccatatcatctgcctttggtgaatactctataacaactgttttatacatttttccacctcctaatctatcacaaattgtaatttataatttgcttattacttttttctgtcaacttctttgtttacactattgctaataatatagaaattggaaatatagctactggataaaattcttattttcaatttttcaatttaaaaattttcttttggcgcttagtttcaaatttccaataaccatgattacgatttcgatgttttttttgaatcttgttttgattgtttttcatggcttgttcagcatttaatataatagcttttttttcgttggaaacaaatttaagaaaaacatcatataggtatagccatccatcgtatgagatctcagtaagcgttgactctaatttgatttttaaaaacttgcaaatgcgtttttgttgctcataagtaaacaatttttttgttttatctttgaaagtatttccagacgctaaaaatatatatgataaaaaatttctatagtctgtcgcatcctcaacatctgctgatgtttttctttgaaagtgagcaaaacatattcgtgcatttggcacaggataaaaatctgatggtttaaactcataaatcaattcagcggaaaaccaaggtttgtataaaagagacctcaaactttcgttataaaaaggctgtccagaataccttagaaaagcttcatactgcattatgaaatatatatcttcaggaggattatcatcttcaaatacttttttcataatatcagcagttatgttaaatggaatatttgcacatactttatatggttcttttactgatattttatattttaaaaaatccatctctattatttgaacttttttagattctttatacctttcagataaagttttcgctaattttgcatcaaactctattgctataactttcttgcttttttttgcaagttcattggtaataattccttttccaggacctatctcaattacaatatcgtcgttacaaatattactctttgataacaaggtcgctacaagttgtttactatgtaaataattttgcgaatgttctattcccataaatacctcctttacaaattactatttgttagtcagtttttatataaataattataccatttttatttaaaaatttctatcttttataaaaaatatataaatatgtataaaggttacttcttaattttagaaataaccttttttgtttttattaataataatacaaaccctaaaaataatttaatcaaacctaataccattactctgccttaaaataattaaattgtgaagtcttgctaacttcataagcattccacattatagtttgactagaagccggatcaactatcattacatttattgaatcaactccagttactgcaacccaatgctgattaccgggagttgctccctttacttctgtcgtaataaaatatccttgattaaaatattgtgttattaaggctaatttttcacttcgtgtttttcctcttaaattgacatttccaacataactaaatcctggaactgccttattgactgctgcatattgaagattacctccactatcaaacccattatttttatttaatgcttctacaaaagtgccaggattaaagggacttattgtagtattagcacctgacttttcaataagaattgctattgaagtaaccaagcaccctatcttacctattgtactattagtgttacctatttttatattagcccaactaggatctgtttgcctccaattaacatattccccagaattatttactccataaattactccactccacaaattagcatatttatcacttgataattctgctaattgtttattttgtgcagcattaaaattatattgtaatttcatatcttctactgttttagatgttatttttatatgcaaaactttcttttgtacctcttttggctcttcattaacatttacaccttgttctattactttttcaacttttacttcagaagatagactattcatatcccaaaatattttttttagaatattttttttgttattgtccattgtgacaacatcagttgcatttagtccatttgattgtttaaccgtataaataagtaatatatctttccaagaagccatactaccatctaaaacataatcttcgtgtggatttgtatcttgaattgattggattttatctgcaaactcttgattacattctgcaactacttcattcatagttactgcattagcacttgttttctgattagaaaaaaatattccaaatatagaattaactaataatccaatcaaacaaataactactattattattattgcaacccaccctcctgcaattaatgcagtaattaaagcctttgttcctgcaattattgcctttattgctgaaatagttgcttttgttgcaattctaataccttgagcagtctttcttgcagattctctcgctaattttactgctctttgactattttttaatgctacttgtgctgttttctttgtgttttttgcaacttgtttacttgtttttattgtatttttagtatttttaatagtagatttaacattgccttttttcattttctctttaaaggctttaatctttacttttgtcttttgataattttcttttgttttcatcaaggacttttgcccttgcttattaaattgatgaatgccctcatcaactgttctgttagttgcaaatttaattttattactagcatattctacactattaatatcatcacttacactttcttcggctttttcttttgttcttacaatggtatctttaaatctttctgtttgaattgctgctttgtttagtgtttttatacctttttgggctacatctttgactttaatatttgccaagataaacacctcctattctctaattaccttctccaggtttagttgtcattaatttatataatttggtattcgtaggaaatttgtttataaatggaacaagtgaactacctacttttaataatccttgccctgcacctacatttgttatatatcccatctgtaaatcagatatatttaataatttagcaagttccaatctatctgtacttgcttgattaagcataactataaactctgaatttgctaacattgttctagcagtatgactttgtagtaaatcatctacattttgtgttattccggtacaatatgcaccatatttacgaactcttttccataaagtaaatagaaaattagcagagtattcgtgttggaataacaaatatatttcatcaataaaaataaaggtatttctacctttacttctgttcatagttattctatttaaaatactatcaagaactactaacataccaataggaagtaattgctttcctaaatccaaaatatcataacatagtaatctattatttgtatctacatttgtatttttagcaaaagtatttaaacttccatctgtaaacaattcaatagcaagtgcaatttcttttgcttctggctcattttgttttaaaagttcttctctaaaatcctgtaatgtcggaggtgttccttgataattcccttgttgaaaatgtctataaaccgaagcagtacatctatctataatagatttctgttttggacccagattacttcctccaataagttgctcgcataaagataatataaactctgattttaatattacaggatttgcaccatctccgtactcgctattcaaatccattgcattaatgtgattattacttgttgctgatatatggattacttctccacctaaagcatttattaattgtgaatattctctttctggatcaatgattatgacatctgcatttggatcacgtaaaattacagatactatttcatttttacctgtaaaagacttgccactaccactaactccaagtataaacgaattaccatttagtaattgtcttctatcagcaataatcatatttttacttataacattttgtccataataaataccattttcgtgatttatttcttgaactctaaaaggcataaatactgcaagcgattcggtagtaagagttcttaaagtatcaatttttcttactccaaaaggcattgcagtatttaatccatccatttgttgatattttaatatagagaattgacataagtgttttcttgcagtagttaataaactttctgtatcgttatctaattgttctttactatcagcagtatgcaccatagttaaaacgcatataaacattctttggtcacgagtagtcaaatcatctaaaaattcttttaattctattcgttgttgttccatatcgtatggtataacagcactaaaattattattagaattttgtcttcgttgccaattagttatgtttgtttctacacctaatcttctattttctacctctcttacggcttcatccataggaacaggaattacatcaatactcatcatcatatttctatttaagtcagttagttctgccaccatattgtctttaatataacttgcatattcttttaaaaatataactctgccatatttgtttcccattttaaaataatctttttcaaattcaaaattatctggacatataaaatctttaaaactatgtccttttctcatattttgtatcatatcaaaagtaaaagcattttcctcgccttgtctataaaaatcgtgtatcaaacgtagtctatcttgtgcttctaattcaatacattttgaacctaattgtgaaaaatgatttatcaaatcagcactaattcttgtaaaatagtttcttgcttcttctacactttttttattaacagatattgttaaaaacttttcttgggtaattccatttgctccagttgctttatctaaaagcattttgttgtattcttttctatattcatccaatttatcatttgctaatggtagtaatatatttttttcaaagtcaattttatttaatcttctatttaatatagttatttttgtagtggctcctgtatcaaatgaattaagcaattctgaatattctaaaaacataccctctttgtcacttctacttgctactgcataatttatatctgtaaaacgataacattttgaatatttattttttcctacttgaaatataccatcttgccatattcttgtaattggaataacatcttgcacaccttttggaactataaatgcttccttgtcttgcttaaatagtgtttttaatgtcttcattctttaaatcctccttttctaacttatcttttaataattcataataaaaattaactggtttaaaagttaatttttttggtattaaaaattctgattttatatatgcatatatgaacttctctgccggcattccattataagtaataaaacctattgcagcgaacggacttgctcctaaaatacatacccaagataaagtttctataccaaaattattttttaacaaaaaataaagtaatactgctactccacaagcaagtatagaaaaaacgaactgtcttaatgacagtccgaaaaatatactttctgtgtaatttcgtatttctctatttattttaacttccatactattacctacctttctttatcttttttattttgtataaatgtgtctgcaagatttccaccagatattacttctttaaaatcttcttttgcttttgttaaatcattatcatagtaataaccataagcccaatctattttattgtctgtaattttatcaagaaaaaccaactaaaaatctgattgtccgctaaaacactgtatctatcagcattttcaagggttgaaatacttcaaattactacgattttactaccattgaatgagccttgatacgttagaaatcccagatttgcaaagattatggtacagcacatcagtattgataaactaaaaattgaatatcgcaagtagattatggaacgccgatattgacgttccttttctatttccagccgttcagaaatggacggctttttctatatccaaacgaaaggagaattttaaaagctatgaaaaagatattgaagcgattagccacgagcttccttgcctttgcgactatcgttaccgctttgccgacaacggcagtccacgcttccgagaagcaatactggacagaaagtgccgagcgtgtcggtatcgttgaaaaagtgatgaatgacggttctatcggttcgacattcaacgagggacacatgaccgttgagggcgaggacgctttctgcgtggatattaacactaacttccgcaacggctacaagaccagagccgacgcaagcacacgcatgagctacgaccagatttcagatgttgccctctcaatcgagtatgtcaatcagtatgtgcagagccacagcggattgagcagtcagcatatttaccttttgaaacagtgcgtcgtatggcagagattgagtgttcatctgggctggcaatgcgataacgtcagagcttcctatgatgaaatcccaaaagcgatacaggacgaggtgtacgctggggcgaaagcctttgccagcgagaacaagggacgctatgaatgtggcggttatatctactctggcgagggacaggacattggacagttctgggcgaaacttgccgtaggaaatgccacccttaaaaagacttccagtaatgccagcattaccgacggaaacgggctttattctatcgctggtgcgacttatggtgtctattctgataaggactgcacaaaacagcttgccacccttacgacggataatagcggaaatactgatactgtggaagtaaaggctggcacagtctacatcaaagagctttccgctcctgctggctacaaggtggacaatacagtgtattccttaaatgtggaagctggcaagacagcgaccttgaacgtatccgatacgccaaaggtcacagacacacttatcgagcttttcaagattgacatggaaacacagaaagacgctccacagggcgacgcttctttagagggtgcggagttcacatggaaattctatgcgggacactataccgctgacaatctccctagcgagcctaccaaaacatgggtgacaaagacaatcgctgaaaaggacagcgacggcactatccattacgtttcccgcctttctgatgaatacaaggtatctggggacagcttctatacacaggacggaaagaacgtgcttcctttaggaacgctgaccgttgaggaaacaaaagctcctaatggctatcttcttgacggtgcgtatatgcaggcaaacggtagcgaggaacagattaagggaatgtaccttacacagattaccgaggacggcgacattgccgtattgtctggaagtaatcagtaccatgtatcagacaaggttatccgtggcggtgtgaaaatccagaaacgagatttggaaaccagcgataccaaaggtcaaggaagtgcgaccttgaaagacgctgaatttgaaatcatttcccttaatgacaatgccgtacttgtcgagggcaagctctacaataaaggcgaagtggtaaagacaatccttaccgacattgagggcgtggcttctacttctgctgatttactcccttacgggaaataccgtattgaggaaagcaaagcaccagagggctatctgacggacggcgcagaaccgattgaatttgaaatcacagaggacggaaaaatcgttgaccttacagggacagacacatcaatctacaatcaagtgaagcgtggcgacctagagggtgtcaagattggtgctggcacacaccagcgtcttgcgggagttccgtttaggatcaccagcaagaccacaggtgagagccacattatcgtaactgatgataacgggcagttctccacttcttctgactgggcttcccataagaacaacaccaacgcaggaaagaccagcgaggacggtatctggtttggaataagtgagccagacgacagcaaaggtgctttgatttacgatacctatatcattgaggaattacgctgtgagagcaacaaaggctttgagcttatccctgcctttgaaatcgtggtgtccagaaacaatgtgactgttgacttagggacacttactgatgaatacgagaaagaaatctctatccataccacagccacaggcaaggacggcgagaagtctatcgtggctggcaaagaggtaacaatcattgataccgttacccttgacgggctggaaaaaggcacaaaatatcagctcaaaggctggcagatgttgaaagaggaaaacgccgagcttcttatcgacggacagcgtgtagagaacagctatacctttactgctgatgatgaagaaatgaaagtggaaatttcctatacattcaatgcgtctgatttaggtggcaagaaccttgtgacctttgaggaactttacgacctttccaatgaggacgagcctgtaaaggtggctggacacaaggacattgacgacgagggacagacggttcttatcacggagcgtatcatctctattcataccacagcgaccagcgaggacggaaagaaagagattgaagctggaaaagacgtgacaatcattgataccgtgacccttgacggcttggaaatcggcacaaagtatcagctcaaaggctggcagatgattaaggacgaaaacgcagagcttatcatcaacggagagcgtgtcgagaatgactatacttttaccgccgacagtgaaagtatggaagtacagattgcctttacattcgacgcttccgagcttggcgggaaagagcttgtgacctttgaggaattatacgatttgagcaatccagacgagccgactaaggttacagagcataaggacattgaggatgacgggcagactgtgacaatcacagaagtaccagaaacgccggaagaaccaacagagccggaacagccgaccacaccagatacaccgaccaaaacaagcgacgctccaaagacaggcgataatacaaacattgccttatttttagggcttcttgttctctctggcgcaggcgtggcaggaacatacttcttcaagcgtagacgttcctaatcgggtggtctgcttatgatgatgaagaaatcacgttccccgccgtatggacttgtaacaggaaaagaaaatcgaaactgttccttttctgttcttctgcttgcagatcaacggaaaagaacagtccactaggggcgtggggagtgtagctccccacatatcaatcacagaaagaaatgaggtatgaacacatgaaattgaaatatattgtgcctgatatggcacagacttttggaaatttggagtttgcaggagaaaatgaggtggagcaacagcgtgtcaatggtcgctttgttcccgtgacgagaagctataacctgtattccgacattcagagagccgacgacattatcgtggtgcttcccgcaaaggctggtgaaaagcgtttcaagtatgagcaaaaagtcaagctcatcaatcctaagattaccgccgagggaaagaacgtgcgaggtcgtggctacacaaactatatcttaacggctgatgatatgcttccagccgaggaaagcaagtaaagggggtatcagattatgagattagcgaatggaattgtattagataaggaaaagactttcggagtattgaagttctccgcattaagacatgaggtgcgtgtggagaatgaggacgggacaaccagcgaagaaatcaagcgtagaacctatgacttgaagtgtagtcagcaggaacgcacgatacaggtatctatcccagcggaaatccctgtcaaggactacccgtacaatgccgaggtggagcttatcaatcctgttgccgatacggtggctaacgccaactaccgaggggcagacgtggagtggtacatcaaggcagacgacattgtgctgaaaaataaaggcggtcagtccgcaggcaatccgcagaaccacgctccgcagggacaacagaaaaaataacacattctcttgactaaccgcatacgatagtgtaatattaaatcgtaagtaataagtagtaactagaaaggagaactcaaaatgaaagatttatctattacacaagagtatttgatttgtgcggtaaattccaaagggaaaatttctggatttggttcagagaagttgatttgccttatagcgtctggtttattagaattgcaattagaggactgtattaaaattgataaaaagagagtcactgtgacgaataatcttccagacgaaaagctttatttaaaacctctatatgattttgtaaatcagcaaaaacctgtaaaactggaaaaaatattagaagcatataactattcatttaaggatagaggctatgaacttgttaataccattggtgcttctttaaaagatttaggtttggttgaagttacccgtacaggcatattcggaaataaaaatgcctatattccaaatgcaaatgctgttcattatgttgttgatatgataagggcagaatttttagaagatgttgaagttacggaagatattgcttcgctgattatcctcttagataagagcaaggtgttaaaaacctatttttctgaatatgaacaaaaagagattaagaagaaattaaaagaaataacaaattctgatacaggaaaatcaattaaagatatggtgaataatgtggaatacatgattacaatgatgaatgttttaatcgtagcttatagctaatggagaagttcatatgtctaggcaaagaagtatggaggtaataaaaaattcagagtatgtaactatcggtgaattagtaaggctcacagatgtaagatacagtacattaaagttctatacggaagaaggtatgctcccttttgagcaagcggaagaaaatctgacaagacgttataaacgtgtggaaagtatggaacgaattttctacatcaaagaattgcgtgagcaaaagaaaactattccagaaattaaagccatattaaaaatcgattaaagtaattacaaaagcggttagtctttacgattgaccgctttttccatatccagaaaggggtgtttatgaatattttaaaatacaagggaaagcgtatcagagccagcgacaagaaccttgtgtaccgcttctgcgtaggtacgctcctatttctgttcgtggcggttctcctgctactgaacatgggacagctcatgcgtaccgattgggagcatttcagcctgcttgataatgacgtgacgctttccacatacaacttcataaccatagggatagcgacttttgcctgtgcattggtcgcttttctttattaccgcttcttccatgaccgcttcaagaagctattacaccgtcaaaagctggcacgcatgatattggacaataagtggtatgaagcacagaccgtacaggacagcggttttttcactgacctgcagagcagatcaagggaaaaaatcgtctggtttcctaaaatctattatcaaatggaaacgggcttgctccatatccgctgtgaaatctctttagggaagtatcaagaccagctccttagactggaagataagctggaaagcgggctgtactgtgagctgaccgacaagacgctccatgacggctatatcgagtacaccctgctctatgacatgatagcaaaccgtatcacgattgacgaggtaaaagctgaaaacgggggcttgcgtctgatgaagaacctcacatgggaatacgacatactccctcacgcccttatctgtggcgggactggcggtggaaagacctatttcctgctgacaatcattgaagccctcttgcagaccaacgcccagcttttcatcttagaccctaagaacgctgaccttgcggacttgggtacggtcatggacaacgtgtaccacaccaaagaagatatgattgaatgtgtcaatgcgttctatgagggcatggtggcaaggagcgaagaaatgaaacaccacccagcctacaagacgggcgagaactatgcctatctgggcttaccgccctgcttccttatctttgacgagtatgtggcgttcttggaaatgctggggacaaaggaaagcatgagccttttaagccagctaaagaaaatcgtcatgcttggcagacaggcgggctattttcttattgtcgcctgccagcgtcccgacgcaaagtatttcagcgacggtatcagagataacttcaacttccgtgtgggtttgggacgtatcagcgagctaggctacggtatgctttttggaagcgacgtaaagaaacagttcttccagaagcgtatcaaaggacgtggttattgtgacgtaggtacgagcgtcatatcggaattttacactccccttgtaccaaaggggcatgattttttacagactatcggctctcttgcactggcaaggcaagccgtaccagagaaacaaaaggagattgaatgattatgggatatttggaaatccattatgaaccagaatgtaccgacagtgtacttacctgtatcggattgggatatggaaaattcctgtccgatttagcttttacggcagacagtgattataaacaggacgacgactatccagaaacacttttccatgagagaatgtcggatttattggaagatttggcggaggattatctggaaatgccgttgctgttttccgtggagcttcccgcacacatggcgaacctgctgggctgtcttttccgctatacgtttcttgtcatggacagggagcatttcagacaggtatgccgtgaatacgagattgacaaggatatagccagaaaatgcctttcaagagataccgattgtatcgtagtttatacgggcatgacaaggataggctgaaccactgacggctggaacggtcagcgaagcgacccagaccgtgcaagccgtcctgtggagcagggcttgccctgctccacgaaagaagcccctcggtatctaacagaggggcacaattccgctggaaactacggtcaaaaagtctggaaatcccgctaggcataagggttttcccttactcatggctgactgtgacaatcggcggaaaatatcacactttcacgattgggggtatgcaggctgaatgaaagcacctttataaccgccttgaaagagaaacgcctatcttacggcgtgtcccagacaaggcttgctatcatggctggtatcagccgtgaacacttgaaccgtatcgaaacgggaaaggtcaacctcacggacgatatgcaggacaagctcatggaagcggtcgagaaattcaatcccgacgctcccatgttcctgctgttcgactatgtgcgtatccgtttccccacgctggatatacagcacgttatcagagatatattgaagctcaatgttgactatatgctccatgaggactacggacactacaagtacacagaacattactatctgggtgatgtgttcgtctacacctcgcaggacgaggaaaagggcacacttttggagctgaaaggaaaaggctgtcgccagtttgaaagctacctgctggcacaggggcgtagctggtatgacttcctcatggacgcactcattgagggcggtgtgatgaaacgccttgaccttgcgattaacgacagggcgggcatactggatattccagatctgaccgccaaatgcaatcgtgaggaatgtgtttccctgttccgttctttcaagtcctatgcttccggcgagctggtgaagcacaacgagcaggacaaggcgggcatgggacacacgctgtatatcggctcactgaaaagcgaggtgtacttctgctgttatgagaagaactacgagcagtacgcaaagctgggaataccgattgaggaagcacccataaagaaccgcttcgagatacgattgaaagatgaaagagcctattatgccgttcgtgaactgctgacccattatgacgcagaacagacggcattttctatcatcaatcactatatccgcttcgtggacagagagccggagaagcgaaagacagactggaagctcaatgaccgctgggcgtggtttatcgggaaagaccgcccgcctatcaaactgacgacagacccagagccttatacgctggaaaggacgctgggctggataagccggcaggtcgcccctacactgaaaatgctgaaaaagatagacgctggcaacagcacaagctatctgaaagagattgaggacaacgcaaagctgacggaaaagcatttgcagataatcagacagcagacagcggacacagaggaacttgtcacagagtaaaggagaattttgactatggcagaacttgtcaaggacttggtgctggtatcactgggaatgggtatcggcgttgtccttatgtgtatcgcacaggtcagcaaaatggctgacgaagaaatggaagaaattaaaaaagaaaggattgataaagaatgaatttcggacagaacttatacaactggtttttaagcaacgcccagagcttggtgcttatggcaatcgtggtaatcggtatctacttaggatttaagagagagttttcaaaacttatcggcttccttgtgattgccttaatcgccgtcgggctggtattcaatgccggcggtgtcaaagacgtgctgttagagctgttcaaccgtatcattggagcgtaacaatcagcagtttgcggacacgcaaacttacctgtcccccctatgggagttcgggcatagggggggaatgaaagggggtgacggaatggtacacagataaaaaatagtcatgctatgaatttcattgaatggctgattttcaactgatataatgtaagtatggaaatcataaattaaatttgcgagggtagaaaatgaatgacaaaatgattgtaaagaacttctatgagaggattgtttcagaaaatagacttgaagaattatctaaatatgtatcagaaaactgtgctctgactctcggagacaaaactgtacctttggggttggacggcatgaagcaacatctaatatccgtaaaaaagacttatccagactatacaatgaaaatagtacgtcaattcaatgataaggaatatgtgatttctgaatttataatggcaggtacacatgagggtgaatggataggtattaaacccactcataagaaattatcatttacaggtgtcaatatagacagagttgtaaatggaaaaatcattgaacatggtggttctgtaaatacttttgaaactctcttagaagcaaatttaattaagccagtataagaagtgaggtgactgtatggaaattcgacaattagaaccctttgagattgacgaagctatcactttgatatgggaagtatttttacaatttgaagctcccgactattcagatgagggtattcaatcatttaaggattttattgagaatgatgaaatcctaaagacgcttgaattttttggagcttatgagcaggacgaattgaaaggtgtaattgctacaagcgaaaatcgaaagcacatctgctgtttctttgtaaaagcaaaatatcataggcaaggaattggaagaactctttgggaatatgttttaaaccacagtgaaagaaatgtattcaccgttaattcttctccatatgctgtacccgtttatcgtaaactggggtttgttgaaacagatacggaacagttagcggatggaatgagatacacgcctatgaagtttgtaaatgcttgtatgcaataaatcaaagtgtttggagggaaaaaattatgcttgataaaataccgagtgcagaggaaatgatgactttggttgggcaatcattgtatgatgtatggaataagttatgtactttaattgacgaacaacttactcataaccgcaggagtttaaccgaaacagaaatcttagatattcaaaaccgatgtgaacagctttatgatttgtgtggagaataaaaaaataacctaaaaagtgcgatagcctgtgtaggtgtcgcacttttttcagttggcttggcttacgaaaacagcgttaattattccgcagtttctcttgcctttttcaagccttgagccgtagcttccatcacgataagctccttttcttccatatcattcaacagtacatcaacttgtttgcggcgattgttgtcgccatcttcattgcatggaaaaaagaactggtctacagagatgtcaagcaaggtagtaatgagataaaatttgttaagccttgggtgctgccccctgttctctatatacataatagagcgtggcgtaaggtctaccagttgggcaagatattcctgtgtccacccttttgcttcccgagctttttttatcgctatacctaacggcttaaaatcaagttttctttcatcttggtacattttaatatcatcctatatcattgtacatttcgggtgatgatatttgaacgaagtatgattttatgtttagtagtgtataatttcgtattagtggagagaaacttgctattattcgtcattccgtatataataattatatactctttgcgaaaggaagttgatattatgaattacatttctgtgaaagccgcttctgaaaaatggggcatatcggaaagacggatacaaaaattatgtgaggaaaatcgcattgacggaactgaaaaatttggtcgtgcatggatgataccaaaagatgcagaaaaacccgttgatggacgtatgaaaacaaggaacaaacaggaggagaatcatggaatttaatgaaaagctacaacagcttaggactggaaagaacttaacgcaggaacaacttgcggagcaattatatgtatcaagaacagccatttcaaaatgggaaagcggcaagggttaccctaacattgagtcgctcaagtgtatttctaaattcttttctgtgaccatagatgaactgctatcgggcgaagaactgattacacttgccgaaactgaaaatcgttccaacttgaaaaaaatttacagtttcatttatggaatattagatatgatggcggttacttttatacttttgccgttgtatggtaaccttgttgacggatatatttattctgtcaatctactttcatttacagacactaccccaatatatcttgcaatctattggattgtttttattgttttgattgcacttgggatagcgaaactgatgtgtgtttgttttgaaaaggaatcatggagcaacataatcacaaaatgctctctcgtgctgagtacgcttgttatctgcttcttcgctgcggcaagacaaccctatgtaaccgcccttatgtttctgctatttgttgctaaaatatttgtctggataaagcaaacccaaacaaagtaaaatgccataaaccctttaaaataggctctgacacgataagtgtcggagcttttttcgtgctgacatctattgtgtcggcattgtgacggtagatttcttggcttctatgcaatactcgtggataataagattgtggtcagcgaaaacaagaacagcaacccacggaaaggagaatcaaatatggattatatcattgaaacagaaaatcttacgaagcgatacggaacagccaccgttgtcgataaggtaaatcttcatgtgccaaagggcaaaatttatggtttgctcggcagaaacggagcaggcaaaaccacagcaatgaaaatgatgttgcagcttgctttcccaacggagggaacggtacgcttgtttggcacaaactataaggaaaatatccataccctttatagcaaagtaggctctattatcgaaacaccgggattttacagtaatttaacagggtatgagaatttgcaaattctcgctaaactgcgagggggagtatctaaaagtggagtagaaaaagctcttgaagttgtggggctgcataaggagaaaagaaaagtcttttccgattattccctcggaatgaagcaacggcttggtattgccgccgccattatgcacgagccggagcttttaatacttgacgaaccgattaacggacttgaccccattggaatagttgaaatacgctcatttttatctgaacttagtcacaatcatggcattaccatttttatctcaagccatgttttaagcgagattgaacagatagcagatattatcggcgttatgcacgaggggcatttagtagaggaagtgaatatatccgagcttcacaaaaggaatcgaaaatacattcaatttgatttatctgacagtgagatagccggaaagattttagaaaaccactaccacatgacggattttacagtgcaggacggtacggtgagaatttatgactttagccaaagtgttggagaaatcaatcgagaatttgcacgaaatggactgctcgtgacaaggataaatgatagtgaggaaaacttagaggactacttttctaaactgattggaggtggcggtattgcttaatcttatttcttgtgaattattaaaactaaagcgttcaaaaatggtgctaattagtgtggcaggggtattatctaccccacttttgatgttaatagaagccttgcaaacacattttgataagccggagattatctttaccttgtctgacatatacagcgacagtgtactgtatatcatgctgctggtaaacattatgatatatgtggcaattgcagcttacttgtttagcagagagtacacagaaagcaccctcaaaaccatattgcccatacccatttcaaggacaaaactattaattggaaaattttgcaccctgcttctttggattgttatgctaacccttgtaacatgggcaggtatatttatcgtttgtgggctatatgacgctgtctttacattggagggatatagcttactagtggcaatagtatggctccccaagtttttgtttggcagtatcctgatgtttttaacagtttctccttttgtgtttgttgctatgaaaacaaaaggatttgtcgccccgatgattggctctgccgtgattgtcatgggaagtgccgcactttcaaatcaagaatggggagcgttgtatccgtggacagccacctatttcttggtgcagggtaaacttcagagtaccggctatcctacactgctgtctgtatctattattattcttgtatcagcagttggttttcttatgacctttcatcattttaaaaaggaggatttgaaataatggtacttgattttatagaaattttaaaagttatttttcttggaattgttgagggtattactgagtggctacctatcagcagcacaggacatatgattcttgtggacgaatttatcacacttaatatgagcgaagcatttaaagaaatgttttttgttgttattcaacttggagctatactcgcagtggttgtaatgttttggaacaagatgtttccctttcaatttaagaacaaagcacagtcaattgttaaaaaggatactttctcgttgtggttcaaggttgcggtagcttgtgtaccgtcagctattatggggattctatttgatgattatttggatgcttacctccaaacccccattgtgatttcaatcatgttaatcttttatggtttgttattcattctcatagaaaattggaataaaaagcgtactcctactactatggcactttctgacatcagctataaaacagcaatcttgataggggcatttcaagtgttatcacttatacccggcacatcacggtcgggagcaacgattataggtgctttactcataggagtttcacgagtggcagcagcagagtttacttttttcctcgcagtacctactatgcttggagcaagtgcttttaagctgttaaaattcgggtttgaatttacaagtgcagaactgctcgctcttgttctcggtatggctgtggcatttgcggtatctgtcttagtaattaaattcctaatgaactttatcaaaaaacatgattttaaggtgtttggttggtatcgaattgtgcttggtatacttgttgtacttataaaaatatgaaatggaacgtctatggaataaaggtggaaaggcatggacttatgagtataaatatcgccgaggtggtaagacactctgtgcgttatatgccagagaaaattgtataggatttatgattatctttggaaaagacgaaagagcaaaatttgaagcagaacgcaatgattattctcaacaagtccaaaaaatctatgatgaagctaaaacctatcgagatggtaaatgggtaatgtttgaacccaccgatacatcaatgtttcaagattttattaaattactaggaattaagagaaagccaaataaaaagtaataattatcacgttggcgtatacgaaatcctaattttacaatttcatatcccacacacaaagcggttactccattggagatcaaccgctttttctatactcaaatttaagattggagtgattgattgaaagatatttttaccgatatgcaggcaaaaatcgggtgtccgtatctctccgacctgccctattacaagcgtacggtctggtttgagatgaaacgcctttgcctgtctgactaccctaagaaacagttagaagatttttcacgctatgtattcggtgtgccttacgccgtcatacaggaagcgttgacaagagaggacgtgatgaaacatggaagaaatgcgtgtgcagattgaagcacgagaaccgacagacgacgagatacgagccttttggttcaccctgcctatcgacacggaacaggtggaagaactgctggggattgatgtagatacagactattactatatcacgggcaaggagcttccctttgctgatgaagtgcaggaagataccaccgtcgaaaagctcaatgacctgtaccatacctacgaaaatctaccctctgatttgaaagaggactatacggagctgatgtgctatttcactgaccttgacgaactgcaccgatacagaaacgacattattcattattcttggtgcaagaacatgacggacgttgcccgccacattctgaacaatgacccagactttacttccctaagtgagaacgtcacccgctatttcgattttgaagcctacgggcagtaccttgacgacaacggacgctttgtggaaaccgaccacggtatctatgaacttccgtagaaaagaggtgtgtgcctatggttgacgacattagggtgtatatcgctaatcttggcaagtacaacgagggcgaacttgtcggggattggttctctttccctatcgacgaggaagatgttgcggagcgtatcgggctgaacagctattatgaggaatacgctgtccatgataccgacaacttccctattgaaatcggggagtatatctccattcaagaactcaatgagatgtacgagatgatttgtgagcttcccgactatatcacagacgctctggacgagtttgtttcccactatggaagtctggaagaagtctacgaacataaggacgagatttattattatccagactgtgcggacatgaccgacgttgcctattacttcattgacgagttgcaggtattgggacagataccgctaccgttgcagaactatatcgactatgaagcatacggcagggacttgtccatagaggggacattcattgaaacaagccgtgggatatgcgagataccatattagagctggcagattagcgacagattaggtcgctactgtcagctttttctatcaaggacagtctgaaaatggctgtccttttccattacaatgaaaggagctgaaacgaattgaagaagattaagagctacacgggtatctggaacgtggagaaagtcttgtatgcaatcaatgacttcactctcccgtttcccgttacctttacccagataacgtggtttgttatcacggagtttgccgtcattctcttaggggacttaccgccgttatcgtttatcgagggggcatttttaaaatacttcggtattcccgttgccctcacatggtttatgagtcaaaagacctttgacggcaagaagccttacagcttcttgaaatcgcagattacatttgccttgcgacctaagactacttatgcaggaaaagccgtgaagctggaaaaggaagtgttcagcgaacctgtcacggcggttaggagtgtgatgtatgttcccgattaagtatatcgacaacaaccttgtctggaacaaggacaatgaggtattcgcctattatgagctgataccgtataactattcttttctgtcagcggagcagaagtttatcgtccatgacagctttcgtcagcttatcgcacagtcccgtgagggaaagatacacgccttacagatagcgacggaaagctccgtaagaagcatacaggaacagtcaaaaaaactggtgacgggacgacttcgtgatgtggcgatacagaagatagatgaacagacagaagcgttagtaagcatgattggggacaatcaagtggactaccgcttttttatcggcttcaagctcattgtgacagaggaaaaagtgagccttgacagcatgaaaaaatcggcgtttctgacgttcaaggaatttctaaatgaggtcaaccacacgctgatgaacgactttatctccatgccagatgatgaaatcaaccgctatatgaaaatggaaaaactgctggaaaataaaatctcccgccgtttcaagttccgacgcttggataagaacgacttcgggtatcttatcgagcatatctacggcagggacggcgtggcgtatgaggactacgagtattcgcttccaaagaagaagctgaaaaaggcaacgctcatcaagcagtatgaccttatccgtccgacccgctgtctgatagaggaaagccagcgatacataaggctggaacatgaggacagcgagagcttcgtgtcctactttaccgtcaatgccattgtgggcgagctggattttccgtccagtgagatattctacttccagcaacagcagttcacgtttcctgttgatacgagcatgaatgtagaaatcgtcgggaacagaaaagccttatcgactgtccgcaacaagaaaaaagagctgaaagatttggacaaccacgcctatcagtctggaagcgaaaccagctcaaacgtggtggacgcattagacagcgtggacgagctggaaaccgacctcgaccagagcaaagaaagtatgtataaactttcttacgttatccgtgtgtcagctcccgaccttgacgagctgaaacgacgctgtgatgaggtcaaggacttctacgacgatttaaacgtcaagctggtgcgtcctgctggggatatgctggggcttcactctgaatttctccccgccagcaagcgttacatcaatgactatgtgcagtatgtgaaatccgactttctggcagggcttggcttcggggcgacacaacagcttggcgaaaatacaggtatctatattggctattccgtggacacgggaagaaacgtctatttacagccctctcttgccagtcaaggtgtgaaaggtacggtcaccaatgctctggcttccgcttttgtcggttcgctgggcggtgggaaatcattctgcaacaatctgattgtctattattccgtcctctttggcggacaggcggtcattctcgaccctaaatcagagcgtggcaactggaaagaaacgcttccagagatagcccatgaaatcaatatcgtcaaccttaccagcgataaggaaaacgcagggcttcttgacccgttcgtgattatgaagaatgtaaaggacgctgaaagtctggcaatagacattctcacattccttacggggatttcctctagggacggcgagaaattccctgtccttagaaaagcggtgcgagccgtgacccagagcgatcagcgaggacttctccatgtgatagacgagctacgcagagaggacacggcgatagcccgcaatattgccgaccatatcgacagctttacggactatgactttgcacatctgctgttctctgacggttcggttaagaacgctatcagcttggacaaccagctcaatatcatacaggtggcagacttggtacttcccgataaggacacgacctttgaggaatacaccaccattgaactgctgtccgtagctatgctgattgtcatttccacctttgcccttgattttatccacagtgacagaagcatttttaaaatcgtggatttagatgaagcgtgggcgttcctcaacgtggcacagggcgaaaccctctccaacaagctggtgcgtgcgggacgtgctatgcaggctggcgtgtactttgttacacaatcctctggcgacgtgtcaaaggagagcctaaaaaataatatcggtctgaaattcgctttccgttctacggacatcaacgagataaagcagacccttgaatttttcggtatcgacaaggacgacgagaacaaccagaaacgacttcgtgacttggagaacggacaatgcctgcttcaagatttgtacgggcgtgtgggcgtggtgcagatacaccctgtctttgaagaattattgcacgcctttgataccagaccgcccgtgaaaagcgaggtggagtgatgaaagataggataaaggggcttctgacaaaaaagaagctctttcgttttttcaagattgctctgatagtcatttttacctctgttgtgttcctctccctgttcgggacggtggctcatgccacggggctggttgatgataccgtcaatgcggacaacctgtattcacagtacccgctggaaaactaccagcttgacttctatgtggacaatagctggggctggcttccgtggaactggctggacggtatcggaaagtccgtacaatacgggctttactgtatcaccaattttatctggactatcagcctgtatctttccaacgccacagggtacgtcgtccagcaggcatataagctggacttcatcaacgacatggcagacagtatcggaaagagcatacagaccctagctggcgtgacggaaaacggcttcggaagtacgggcttttatgtaggcttcctgcttctcattatccttatcgtgggtatctatgttgcctacacaggacttatcaagcgagaaaccagcaaggcattacacgccgttatcaactttattgtggtgttcgtgctgtccgcttcctttattgcctacgctcccgactatatcaagaaaatcaatgacttttcttcggacatttccacggcttcgctggatttggggacaaaaatcatgcttcccgacagcgacagtgcgggaaaagacagcgtggacttgataagggacagcttgttttccatacaggtacaacagccgtggttactcctgcaattcggcaacagcgatatagaagaaatcggggctgaccgtgtggaagctctggtatctgctagtccgtccgcagacgacggggcgacccgtgaggacgtggtgaaaacggaaatcgaagataacgacaatgacaatctgacgataccgcaggtcatcaaccgtctgggaatggtgttcttcctgcttatcttcaatctggggataacgatattcgttttcctgcttacgggcatgatgatattctcccagatactttttatcatcttcgctatgttcctgcctatcagttttttactttctatgatacccagctatgagaacatggcaaaacaggcaatcgtgcgagtgttcaatacgattatgacaagggcaggcattacccttattgtcacggtggctttttctatttccagtatgttttataacatctccaccgattacccgttctttatgattgcgttcttacagatagtgtgctttgcgggtatctacatgaagctgggcgaccttatgagtatgttcagcttaaatgctggggacagccagagcatgggacgcaggatattccgccgtccgtatctgttcatgcgacacagggctagacgtatggaacaccgtatcgcaagggcggttggaaaaggaagtatggtaggtgctggaacgggagctatggcgggagcggttctttcttctgctggaaacaaacaatcccatgccagcacgacccgcaagcgtgacaatacttctttcggaagccgagcgggttcagccgtgggtgcggtgcttgatacgaaaaacaaggtcagggacaaggcaacggctgttaaggagaatatcaaggatatgccgacccagaccgcctatgccctgcactccgctaaggaaaaggcaaaggaaaatgtgtccgatttcaagcgtggcattgtgcagggacaggaaaccagacagagccagcgtgccgacaaactccaacagcacagacagaatatcgctgacaagcgtatggagcttcaaaaagcacaggaagcaaaacaggctggaagaacgacggacggatcagcgacaacaggagctacccgtccccatgacagacctgtgactgcttctcctgcttctaagaccgacacagggaaagtgcaggaaatcaagcgtcctgtcaccacggataaggtacataccgagccgacaaaggcacagcctgtcaaggagcgtccgcttgcttcaaaatctgctgaacctgtattgcagaaacacggaacaaggctcaatggtgtggagctgaaccagcagaccaccagaaaggagcgaaacatcaagaaagcgaccctaaacatgacaggaaagaaaggacgtaagaaatgaaattaagacatatcgcccttatcggcagtctgtttccctttcttcttgcgatagtgctgttctttggcgtgcttatcagtgccgaggacgacgacgggggcggtggttcttcctcatgggtaacgggcatgaacctgtccgcagaggtgttgaaacatcagcctatggtggagaaatacgcaaaggaatacggcatttccgagtatgtcccctatctgctggcaatcatacaggtggaaagtggcgggacagccgaggacgttatgcagagttccgagagcatgggcttaccgcctaactctcttgatacggaaagctcaatcaagcaggggtgcaagtattttgcgtccctgctttcttcagcagaaaatcaaggcatagaggatataaacgtggtgatacagtcctacaactatggcggtggctatatcggctatgtggcttccaatggaaaaaagcacagcttcacgctggcagagaatttctcccgtgataagtctgggggaaagaaagtcacctatacgaaccctatcgctgtcgcccgcaatggtggctggcgatatgcctacgggaatatgttctatgtggagcttgtcagccagtatcttacggtcagtcaagtatcgggcgagctggcacagaagataatgaatgaagctctgaaatatcaaggctgggactatgtgtacggtgggagcaatcctaacacttcttttgactgttcggggctggttcaatggtgctatggcaaggctggtatcagtctgccgagaacggcacaggcacagtatgacgctacccagcatatcccgctttcacaggcacaggctggggatttggtgttcttccacagtacctatgacgcaggaagctatgtaacgcacgtcggtatctatgtgggaaataatcagatgtatcatgctggcgacccgataggctacgccgatttgaacaatagctactggcaacagcaccttatcggggctggcagaattaagcaataaaaagaaaggaatgaaaatatcatgttcaagaagaaagaaaaaccgataaaggaaaagaaagtccgtactatgaaagtggggacgcataagaagtccgtcattgccctctgggtggtgcttatcgcaagcgtgagctttggtgtgtataagaattttacggctatcgaccagcacaccacccatgaggtagaaaccatacagctacgacttaacgataccaacgggatagaaaatttcgtgaagaatttctgtaaatcctactacacatggagcaacagcaaggaagcaatcgaagcaaggacacaggctatcagtgcctatctgacacaggaattgcaggatttgaatgttgataccgtgaggacggatataccgaccagctccacggtcacggacgtgattatctgggatatagaacagtctggggagaacgctttttctgttacctatgaaatagatcaacagataaaagagggcgaccagacaagaaatgtatcagaaacctatactgtgaccgttcatgtggacgctgacggggatatggttatcatacagaacccgacccttgcccctgctatggagaaatccagctatgaaccaaaggcacaggaagcagacaacagcgtggacgctgatacagcgggtgacgctacggcgtttctggaaacatttttcaagctgtaccctaccgctacggacaaggagcttgcctactatgtagagggaaacgcccttgaaccgataaacggggactatctctattccgagcttgtcaatcctgtattcacggctgacggcgacaacgtgaaagttaaagtagctgtaaaattcattgacaatcagacaaaggcgacacaggtatcacagtatgagctgacgcttcataaagataataactggaagattattggataaagtgataaagacttgcaacatacaaagtatgctctgcaagtctaatttctattgacaggggtaaaatcatcatatatactatatacagaccaacggtttgtatatggaggtgaattatggcacgaaataaatatccagaagaaacagtaaagctaatcttagatgtatcaactagactgttttctgaaaaagggtatgacgatacttcattgcaagatattatcaatgaaacaaaactttctaaaggagcaatttatcatcattttagttctaaagaggatatattgaaagcgatttttcatcgactcggaaatgaaaatgcagaaatatttgcaaaaataagagatgatagtcgcttaagtggaattgaaaaattaagaaagatatttcaaacggcagtattccactctaatcaaagtgtattacttacagtatctccctgtttgctgaataatccacgatttttggcaatgcagattgaacaaatatatgagctgatagctccgcaatttgtagaaccgattttaacagagggtgttaaggacggctctataaatattgaaaatccgcatgaaattgcagaagcaattatgatactaacaaacgtatggctaaatcctttggttaaaatgactgacacggagggtatgaaaaaaaggtgtgatacttttaatactcttttaaaaggattgggtatagacggcttgcttgataatcagacaatttctgcttttgttcaactttgcaataagaagtaattcatcattttaatagactgcacacacattttggaagtgcagtttattttaaaccatatataaaccgacggtcggtttaatttaaaggaggataacctatggaagtaaaaacaaaactttttagacgtgattttacccttgtagtaattggacagattatatccctttttggtaatgcaattttgcgttttgccctaccatattatcttttaaaagaaacaggttcttctactctttttggacttgttacagcttgctcatttttacctatggtagttttgtcaatggtaggtggcatactcgctgataggataaataaaagaaatataatggttggactggattttagtacagctattattattacgttgttctatttatcattggggaaactaccaatggttccattgtttattgtatttttaatgctactatacggtatttctggagcataccagccgtcagtacaggcaagtgtcccattacttgtatcatcagataaattgactgttggaaatgcggttatcaatcaggtaaatactttggcaaattttgttggtccagctattggcggaattgttctgcaattttatggaataacgcctatcttgattgccagtattgtatgtttcactttttcggcaattatggaaatattcatacatataccatatcaaaaacgtgttcgtgaaacaggagtttttacagtagctaaaaatgatttaaaagatagtttcagatttttaaggcacgaaaaacctatatttatatctgtcattattttggtatgtatttttaatctggtattaagtgccgttttgattgttggcttaccaattttaatttcagaagtattgggaatgtctgatacgttatatggattttcacaagcgtcactttctttaggtggattatgtggtggctttttgacggcaatagtggcagaaaaattaaaacttaaaaatttgtatgttcttttattgatttgctctgcttctgtatttttaatgggaatttcacttttactaggattaccagaaataatatcttattgggtgattacgctaatgtgttttgttgctatgggtgtgtctacattatttgtagtacaaatatatactgtggtacaaatgcaaacaccaccagaattagttggtaaaatcatggcaacattagtttctgttgctatgtgtggtcagccgataggacaaatgatttacggtattctatttgatgtattttctgaaaatgcttggatagtaatgcttatagcttctatcgcttcgattttaattacatggtattcaagacaggtgtttaaacaattagaatactaatatatgaggtacaaaaatgagaatactaaaaaagcaggatattaaaaatatgctaaaggttggggcaaaagctagaggcgtgtcggtatcagagtttagagccgagatacaggaaaacattgacaatgctgtgaatagtcaaaacccagtggtgcagaaacattttaaaaagtattttggtaataagatacctacaccagaagaatacatttacacaatcacaaagaaaactaagatttaagtgcttatcctgcttcctgcggagcagatcagcaggatagcttatgagaggaaaaagaaaacgagaagtctatttgcttcccgttcccttgtatttcatgataccgtcaatcgttccttgaatgattttgagttcttcatctgtcagttcatcaagcgatacgtctatctgtctgcggattgtagatttttccgctttctcctgcggatagaagtattcatcaacagagatatggaacattgtcactaaatcatgaaataactggaagctggggtgtttccctatattctcaatatctgcgatatgacgttctccgtaaaagaccttatcgcctaagtcattacgggaaagcccagctttctctctcgcttctctgattgccagtcccagcggacggaaatcaaaactgtgcgtgtctttctttttcctcattttaaatcacctgtcatgagtttatacttcatggcacatgattagaatgtgttaaaaacgcatatattatgcgttaataattcatatcaatattaccttgacggtaaataaaaaaaaccgttctagggtaatatctttttccatgtctttcaatttgattaggacggttttggataaccagagctgtccttttcttttgcactcacggtacagctctgaataagggggttgtgctatgattgcataccagcgaatacgccagtattcacaactgaataactgccttacaatggttatccagtcaatacaccttaaacatgagttaaaaattcatatcgtaaacataacaaaaacagtctgttggtacattcatgtgctgattgactgtttttgttatttatgagaagttcaatatttttttgaatttctttcttatacaggttagcaaatcacccactcctgtaccgatgtggggcggaaagagggatagataccttttacgtctggacagagagggggtgagatgatgaaaccgtctgacttccaaaaaacaatccagtgtcagtttgactgtaagctcaaacgtactgttaagggcgttatctggaattataaaaaggaattaaaacgtcgtaaagataaagaaattcctttctgtgagcttccagaaatcgttgttgaaaagctggctgtatgggacgagtacatgagtgactataccgtgtttgaggtatgcggtgttgaaatccgagtgcttgatgaagaactttcagaagcattaaagcaattatcggaacgtaaccgtgaaaatcttctgatgtactactttctggaaatgagcgatacagaaattgcaaaagcacagaaaatttccagagcaggagtttttaaaaaccgttatagagctttacaaaatttaaagaaaacactgacaaaggagcgtgaatgaaacatgaaaaaagggtacaaacttccaccctatcgacttatttcatctgctgtggacggaaatgaacagtctattgaaagaatactggcattttatgacccgtacatatcaaaatgctgtttgcgtcctctgtatgatgaatacggtaatgtttatatcgtagtagatatggagcttaaaggacgtatcagagaagctattatcaaaatgattttagacttcgatattggtacagttccaacagaagaataaagcaatcatggcagggcatgatttgttgaaatcccctctttcctgtcctgccctctgcttttacacatgagagcctatggctttcgccactgttctttgacaagtgaataaagcagacagatacgtttgtgatacagcgagccacggggactgtacgccacgaccttttccataaggggaagcgagcgacccatgcagtgatccgagagtgaccgttggaaaagtcgctttgccacgacctgtattcacagaataatgatacacccgcatggtgcggttctgcccacaggaatgggaatggctgaaatgccagtggagcttgccaaagccgtctgtctgcttccataagacacacagtaaagggggtgcatacttatgaacaatactgatgtgcctatctgggagaagtacacgctgacgattgaggaagcgtcaaaatacttccgtatcggggaaaagaaattgcgtaagctggcagaggaaaacctcgacgctggctgggtgattgtgaatggaaaccgtgtgcagattaagcgaaaacagtttgaaaaaatcattgatacattggacgaaatctaatgtcagcgagccgtaggtatggtataataaagtatagcgtatcaacggctcattccttgacggaaaggagcttcgcactatgtctaatgtaaagagaaaagacagcaagggacgcaatttacgacttggagagagccagagaaaagacggaagatacgtttacaaatataccgatatgtacgggcaaccacagtttgtctatgcttggaaacttgttccgacagacaagacacccgctgggaaacgtgaagatttgtcattgagggaaaagcagaaaaagattaagaaagacctcgacgacggtatcaacaccataggcgggaaaatgacagtctgccagctttatgcaaagaagaacagccagagaaagaatgtgaaacgcaacacagaaaaaggtcgccagtatcttatgaaaattctggaaaacgacccgctgggtgcaaggagcattgatacggtgaagctatcggacggtaaggaatgggctatgcgaatgtatgagaatggcttttcctacaagacgattagcaattacaagcgttctctgaaagcgtcattctatatggcgattgaggacgactgtatcagaaaaaatcctttcagcttcaaattgagtgacgttctggaagataattcagagccaaaagtcattctcacgccagagcaggaagaaaaaatgcttgcctttatggaacaggacaagacgtacagcaagtattatgatgaagtggttattcttctggaaacggggcttcgtatttctgaattttgcggtctgacagtccatattgatatggcaaaccgtattatcaatgtagaccaccagctattgaaagacagtgaaatcggctactacattgaaacacctaagaccaaaaaaggagaacgtcagcttccaatgacagaaagagcctatcaagcctttaagcgagtgttacagaacagaggaaaggcagagcctatcatcataggcggttacagcaatttcctgttcctaaaccaaaagggctttcctaaagtggctggcaactacgaaagtatgttgcgtggacttgtgaagaaatataacaagacacataaagaccagctaccaaacatcacaccgcactcattcagacatacctactgcacgaacatggcaaacaaaggaatgaacccgaacaccctgcaatacatcatgggacattcaaacatcaccatgacattagggtattacgcacacggtactttcaattcagcgaaagcagaactagaaagactggctcttgcttcttaaatcggtgattgtactactcatttactacttttggttgcattttcatgctggtaaatgccagcttatgcaaagtatcttccaaatggaaaatgccgataaagccctaaaatacaggctataccgacatttaccagcttatgaaaagataatcagaaatttagtaagtttttatagtaaaatgcaattacatattctttattgtcatcactttttctttcaactaaagcaataggctcatttcttctataaccaacatcaagaacaatagcattttctaattctcttgtttttttagaatccatactaactcccgtaaacttttcatattcttcattgattttgtctttattttcaattacccattcttcaagcatttcataggctgaatacttttcatttttatattgctcactttttaagaactcccctgcaaccatactacaaaaatcataacttatatcattttctggtgttgaggattttgaaagcatatcgtttaataaatcataacctaaaacaaaagtaaaataggatttttcactttctacaactgatttatcaacataaaattcatcaatataatctcttacattttgttttagtcctattgtttttaaagatacagtttctatttcttccccgttaatataatcttgttgattttcgtaaatatgcaccaaattctcgttgtcattatcaagatttttatcatctgcctctatgacatatcctttatattccatagttttatataatggtagtccttcaaaatatttcataacatcaggtgtatcaaatcctgttttattatccaaatattcctttgttattccattatctgcacaatattgcaaatatttttgaactccatctttatattcaatatcatttggatataattcattgatagaattccaaatactataatgaacattgtctgtcatataaataatttttttaccttcttctaaataattataaatataattatcaaagttataatcccattctggaacatttacatatccaccttcatattcttttgaatatggcgtaaattctattgcttcatctacaccatcacttgctaatatataagtttcatttttttctgaatcaattaatatataatcaattttcttattttgatgttccattgattccattaaaaaagtttcaatattttcttttattttttgtattctttcgtccatttgacacctcctataatcccatcatttcacgaacgactctatctgataattttattgttcctacaagcactaacatattaaagactaactctccaatatatttccatacttgagtaactgctgctgcatttgcgtcaaccactggtggcgaacttgcaaacagtgaaaatataatacaagaaagaacaataattgctccctctaaacaaacagcacagtaagacttgataaaacttttaccaacgctttgtgtaggctcacctgcaaatgttgataatggtattggtgcaatagcagtatataaatataatttaaagaatctaccatatactgttaatatcattatgaaagataatactgttataaatagaccacctatcagtgttactgcccataatggtatagactcaaagaaaccacaatcttcaactgctgttattattgtttgtggcaatgttgtacttgttgttcctcctaaaccagaagcagtaattatagttgaaattacaccttgaactattttgaataatgaaagcattagatcaagtccataagttacaactatttttgctattgcaaatcttataaatagttttaatgcgtgttccggcttttttacttctgcaaacgagccacaagtcttcataacacctactacaaaaaacaatactaataacgcaagaccaatcgcttgtaatgctccgtgaatattcagaattacttgccatatagtcccacctttaaaagtttccggagtttgtgtcactaattgccatatttcacttaattttgaattccaagtatctagtgcattttgtaaattttgcactacccaattatcactcaataacaacacctccttgtataaataagatgagggcaagtaataatactcgccctttgataattgttatcctgcaatcatatttaatatttcttttgcaaatgtgattattattccacctgcaacagtcaaaaatccatttgctctttggcttggatcgtgactctttaaagataatcctacttgaactataccaaacccaagcaaaatcattcctattgctctaattaatccaaaaataaaatcagataaattattaacaactgacattggatcatcggctgctaaaacattcatacttgttccaatagttagagcaaatatacatacacctaaaacataggctttaaatatttttttaactttattactcatttttaaactttcttttttctttttcattatttctaatctccttttcttttaaaaaaatcttctatttcttcagaagtaattaattcatattgttctgttatttctttagtttcatcaaaattataattatctaaattatcatcaataataattgaagcaatagcattttcagttcctccgtgtaaataaggtttttcttttccatcggtagtaaatgcaacatttggatgttttaaaatatcatatttaaaatccataatcggtctttcgcctctaataaataaaattgcatatttattatcaagtaaccttacttcatcaggagtaagtaattctctaccactaatctgataattagttgagtaatttccacctctaccactacttttgccataagtattagtatcaatagtttctttacctaataactctgatacatatttgtgcgttgattgttcatttccaccaagatacaaaaattcatcacaatttccaactatactttcccattgcttttcaaataatgcttttaattgtgctaaattttgtaaaataattgatactgatacttctcttgaacgcataactgataaaattttatcaaagtcatctggcaaacttacattagcaaactcatccataacaaaatggacgtgtactggaagactacctccatatttgtggtctgctaaaaaaaacaactgctgaaacagttgtgtgtataaaatactaactaaaaaattaaaacttgtatcattgtcaggaatcaaagcaaataatgcagttttcttttctcctaaagatggtaaatctaattcatctgttgcagttaatgaagcaagactttcaagattgaatttctctaatcttgctgcaagtgtaatttgaatagatttaagagtttttgcagagccactatgataatctctataatatttaactgctatatgttctggctctcgttcttctaatctattaaataatacatcaagaggactaacataactatcatcatcttcgtgtacttctcccgctcttaataattccataaccatagggaaattttgttcttcttctggtgcttcatattttaaataaaataccaatgctaataacaacatacttgcagcagtatcccaaaaaggatcattgctctgacttcctttcggtgttgttgatttaaaaagattcgttactaatttttgaacatcgttatcatcttttaaatagacaaaaggattatagcaatggcttttttccatatttattaaatctaaaaattttacttcatatccttttttctttaataatgcaccaacatctcttgctatttctccttttggatcaagaataaccatagaagtattacattgcataacattcggcttacaataaaatcttgttttaccggcaccactacctccacaaactaaaacatttagatttcttctatgttttttaccatttaatcctattactacattttgtgttaatattttattattttctattggggtttgcttgtattttttatttatttcggttgcattaccccattttgcagagccgtgttcttctctcctacgataattttttttagtagatatatatagtgtaattgccattacataaacaacaataaacactagaataacttttaaagaattatcacaccaagtaaaatgaaaaggattacttataatattggaaaaatcctttattatttgtggtaatcctccatttactgatggtgctatcaaaattcctgaccatatcgtaggtatcaatccaatacaataaacccactttggatagttagaatctgtattcatctctcctcaaacaccttgtgagaactttttttttaactggggcatctattgctcttaataaaacttcatctacatattctgtatctttgccctcttgaatcaatttatttctaaatgcatttaaagcattgataagaatacctagttcatatttgtcaagttctaaaactttaatttcctctttcataaattcctcctatctttcgtgttccttatttttttgagttttagaaattgtttcaaaataagcactcattcttgtatttatatcttccataacgctacgcatagaagtcaattcattttttacttcactagaactcatatttttaaatgaatctggaattgaaatgtttatattggatacatcaattccatattttttacaaagcatataggctgtagaattacatttaaagttatctaattctaaattaccactttcttcaagtcctactcttgttaattctctggctaattgtttaaatatttctggtgtttctccacctctttggacatataaagcattatcacttttattccattctacaacactgttattaccattttgaatatcatctactgcttttatatcaacaggacaatctcttaataatgcagttaatttaactttgtcatcataattaattaattttggtttttgattagaagttgtttgagaaatatcaaacatctttttaacattataggaaattccagaagtaccatctgctcttgtaaaagaatctcctggctctaatattttaattccattttcgcctttttttataaaagcacctgcttctttccaatcattgaattcttttaattgtgttgcagtaggaagtgttgcagtaattacgagtgcattgccaacagagtatttatctaatctgccttgaacatctaaatactgtttatatttattaacatctgatttaatttcatttgccattttatccattaaatcgtatacttcttgtctttcttgttgttttttttctatccaagcatttttatcaaatggctttttattttgagtagttttactaccattggcttttgccattatttcatccaaatcattcatattttattaccctctttctttatcttttttcttttttgattttggttgtttatgtttagttgtcttatttttttcagttttttcatttttaagttcagacttatctaaatctctttctttcttctgttcttctttaattgattttatttcttctctaacagaaggtttatcagatttagtacccttgtctaacttgtttttgttgtttaaggtaggctctaacggagggtttttttccgtttttgccaattgggggtttgacatttcattttcctccttattaattggtttagataaaatgtcatctacaagtctttcttctacactttttataacaactcccttgtctttgctatcttttgtcttttgaatttcacttttaatagaagccttatcataagtagaaagattaaatctatcaacaatacgatttattttacttgcatcttctgcacgtaccataatatctaccataccatctacacttttacctttactctttaaagcacagaataatactccatatcttttggcttcttcagtaaacttttttaaatcttcttcttttacagtaaatactttaagttctttcccagatttaagcatattagtaagtcttgtttttccctttgtttgttgtttgtcttttaatattgccactaataatgctgcaatattttttgcaccacttccacttaatcttactgctacttcaaatccttgcaaactcattcttacaatagattcagcagcgtcacctgatgtgttcatttttttctacctcctttacttttatattttcatcagataattcttgaagatttttttctatcttcttacttctttctaatatatctttacatagcaccacctcctttcgtaatggagtaatttctttatttaattcattaatttgttcccttatttcatctttttcttgtttagattttgattttttatgtttgtaccaaagtttacttctttgatccatcaaatcattaagttgtttttccttttcttctttaaacaaaaaaaactgctcatcagtttttaaattatttctgacaagcagtttagtttcatttgatatatcttccatcttcctaacatcagcacgaatagcaggagataatttttgataaggatatttttttggaaaaacttttaagagataacaataatgaatatataaagcataaaatccctttggttttcgctttttataataattagcattaatctttttattaattccatattcttcaacaaatggaactttcttaatgtgttcttcttcaattctttgcgtaatcctttcaatagaatattcactaccaaaatatctttcaatacgaatattttttttatatggacttctttttatacttaatttattggctctataaataagttcataatccattgctttcattagatcttcaaagtcataataagaagtagccatacctattgctctatctaaatcttcttttgcaatagaataataattaactttattatttaaatctttttgataattagcaaaatttattttactatttctacagggcttttcttgtataactgataatccatattcttcacacaacgaatcagataatcttcttaattctgcataagtttctcttttatcataatatctttttccatctttaaacgatacagaatttataacaaagtgattatgataatgatttgtattaatatgtgtactaacaacaacttcaaatctatctccccacatttcttcagcaagtcttactccaatagcgtgacattgttctggtgtaacttctccctctgcaaaagattgaaatgcgtgaaatccaagtattccatctgtttttccatattgttcttttgtaatactcatttcttcaagtgctgttttaggactacaattaattcctgatacaaaaagttgttcctctgttttataatctgattctacatattcaatcacattgtgtaaatcgtaataattattattttcattatgttttgtcttttctacatttgtagtataatctaatacattatctaatcttttttctattttccatatacctgttgttgccataatcactcctttattatatatatttttctatgataaataagtatatcacatactttattatcttcttcaaaaactctatatctgtgtccccagaaattaatccaaagttttcttaattttttcattttacctcccataaaaaaagagcctatcatttctgataagcccataaattgtctgcttaataaattgtaattttagtgaatagtaacttaattttcttttttattaaacatatggcgtactttatctattcgattatttggtctacgtgattgaataactggttcacaagtagcaatttgataatcttttaattctgtcaaaaaaactgcttgcccatttgtatatagagttaaagtattacgatattcattaatacaacgtacaggaatatgtcctgtaaaaataacttcatcattttttgattgacttgtttcaattattgcacaatgtttttgtgcatctttatatgcacgagaaaagtatccctctggtgtaaaaagtataaacgaaagatatggctctaataattgcgttcccgcttttttcaatgtttgttcaagtacaattggggcaagaaagcgaaaatccgagggagtactaacagggctataataaacaccatattcaaaacatattttacaatctgtcactttccaaccatacaatccttgctccagtccataattaataccttctcttactgcattttgaaaactttgatttaaataaccgagtgaaactttgctttcgtactgtattccagtgccaattggaagtggagttattgataatccaattgatgcccaaaatggatttggtggtacttcaatatgaatagtataatctgccttttgtaatggcttttccaaataaattacggttggatcttcgattcttatgtttatgtgatatttttcaatcaacagagaacagataacttctaactgcactgttcctaaaaaagaaatgatgatttcatgtgttatcgtatcaacataataacgtaaaagaggatcagtatctgcaatttctgtaagagcatccaataatttttctctctcttctatttttatcggttcaattcttgttcgtagtattggtacagtcttgtcattccatacattgcatggcaaaatcttttcatttcctataatatcgttcaatcttaatgtattgttaggtataataaaaatatctccagaacaaactatttttgtctgtatcatttccccatttgaaggaatatatatttctgtaagtttcattttctttttttctggcaacataattgtatctcgtaagtgtaatgttccactataaagacgcaaataaactaatctttgcttatggtctgtatattcaattttaaaaactcttccacatagttctgaatcattctcattcatttcagaacaaaaaagatttgaaatagcttcgataagttgttgagtccctatattatttctagcacttccatggtatataggaaacaacgaaccttttttaacacacctatattcttcatacattaattcttgtatagtcaatttttctcctacaatatatttttctaaaagtttatcatttttggaaattacaggatcccaatcatctaaatcaatgatatttttaattgatatttctggagttaatgttacattttgcataacaataatatcatttgaaagtttttctttgatattttgataaatattatttaagttaattccatcctgatctattttatttataaaaataattgttggtatattcattttttgaagtgcatggaatagtattcgggtttgtgcttgtacaccatctttagcagaaattactaaaattgctccatcaagaacagataaggaacgatacacttctgttataaaatctgtatgtccaggagtatctacaatattgattttgtagtcattccaattaaaagaagtaactgctgcctgaattgtgattccacgctgacgttctaaaaacatagtatctgtccttgttgttcccttatctacactgcctaattctaaaattgctccacttgtataaagcagactttccgttaaggtcgtctttcctgcatctacatgagcaagaataccaatgttgattattttcatggaatttccctccctacaaatttatcttttaacttaaaatcaatatttgctaattttgttcttttaaactattctcaaaatcaattatccacttttctaatgtttctactaatgctaattgttgtttgaacatttgttttccaacattaggaatatgttgtctatgagaacgtctttcatttagtaattcttttaattctaatatctttgattttatattagaaacaagaatctgtttttgttcatcatctactaaatctaaattcgtgataataacattaaaatccaaatatagactaacatcagaatttgaaatatcattcataagtttattaaaataatcattacctttgttagtaatagtatatattgctttatctggcatatttccctctttctctttatggctaacaatatattcttttgattctaattgtaatactttcttataaatagactgttcactaatttttacccatcttggtatattacgatattctatattttttttaatatcataagcactttgtgatttttgtttaataagtcctaataataccaaatctatatttgacataatctctactccttacttaatataatctgtaacgccaagtctatttccaaatggatcttcaaactcgactgcattaccagttccaattttaaaaggctcactcaaaaattttatatcattattcaacatttctttatagaagattgcaacatcttctacttcaaaccatattgtaggctttaaattctcaaatttatttttgtcttttaaaattattgcaggttcttcatttccaatattataagcaaccattcccttatcagagaaatcaaatttcttttttaaccccaatatttcctcatagtatctttttgcttcttccatattatctacaggaagaaaataattgtcataatttttcatatatttaatgtcctcctttctactataaactacactactatattttatagtagttatcgttaaaagtcaatatataataaaaaaatagattagttgcactgaactaatttatttgtataactgcctgtcgtacaaaaaagactgtcattactgacaatctttttggtaaattactatttatcatcttaattttaccagtaatttttacaagaatattatatcattttattctatttttttatatagttctacaaaaattatttttatttatctggacggagatatttgtttttcatatcaactattagttcatctaatttatctatttctttttttagatgaggaacatcaataactttttttgcattagccattcttgcaatttgatttatattgtttcctattttacgaataccttttatatcttcataaaattgttctggtggtttttcttttggcttataacctacaattaaatgtctaatataatcagaggcattcattccaactgcctctgaattacatttcattatataatcttcttcttcgctaagccatatttgtttttttattctacgacttcgcattttactacctccggttcttcttctatttcatcttttaaaactatttgtctttctaattcatttatacgatttatttgtaagcaacacatcaaagtagtcattccaagacctcctattataaaacctaaaataaaaaataataattgactcataattaatcatcttcctttctttttaatattgtttttctagcaaggggattggggatttcccccacaaccgaattcgtacgggagtatgaattcagtgctggctagacaataaatttactccccataagtacattcgccacaataagggcaataatatatacaactttcacaaggacattctgaagaaaattcttcatctatttcttcttctatttcatctgaattttcttcttcttcatcaaaaatttctacaacatctacaacaatttcttggctagaatctaactcaataattccattttctatcacaaattttgtaacaataattgctgcttctcttggattttttgccattatttcaaaataatcttcattgacattttttatttttacctcatattttttttcttgttcttcttctaaaagaccaacagtttctaataaaaaattaacatctaatcctaattcattgcacatttttacgaatggaataaaataaaaactaggctttaatccattctcaaatctagatatttctgcgtgacttacacctattttttcggcaagttttcttgtagaaatacctacttcgctcctccttgttttaataatatttgctaattttaaataatcaaatttcataatatctcacctttctttttcatatctttttttataattaattccttttttagcacacaaaaagtcattgaaatcctttcctattagtggtggatcatcaatgacttcatatttttttggaagaatagttttgagtgccattgttgctattcttcctgcactatcattatcaaaatgaagatatatttttttaatatcttgattctgatttaaataataatttaatgctaatggtatcttactttcatcaattttttttgcaggttgatatactcctgcaagagataaaaggttatcattataccactctttattttccattttctttaatgttgcatacgataataaatcaatcgcactttcaaacaaatgaactgaatctgttttttctgttgattctagtttaaaagaaaatgccttatgactaccataagcatctttcatatatctactactatttgtacctctaattcctgcatatcttggaacattatttttatcatatccaacaaaaacaacattgtgatttggtaaatcttcataaattaatctattatctatgcactcgtttattatgtctttgtcaattccacgactagacaaataactaattatcttatcagttgattcagacctttttggtaaaataagtctaatattttgaactttttttggctgttgatacatagttggtggtttttcattagaatagcctaaaatagtttctactgcttgaataaaagtataatctctaactttgattaaatattccaatgcagtttttcctcctattcctcttgaaaaccaataccacattccattacttatttttaaactatcgtgtgttctagtcatataagttcctctactaaaatatactaattcttctggctcatagttttttaaataagtatataaatccatttcctttgctttttgtatttcttctggttgataatatgccatactattacctacctttctttatcttttttctttgattgcttttctctatattcatctactaaatcagacacagtatctctaacattatcttctagtatttgatttatatttaagtccgaatccatccatccttgatacagagtttctagtgaatttttttcattttttaatgctttaagttcatctatctcaaattgttttgactctggataaaaaagataaataacttcttctttaacagttgtttcataagatttgtcaattatctcctttgtagttaaagtagataattcctgtttataagaagtaagttcttgttctaatttttcatataattcttgtcttattttttcttccataatatcaattcctttcttaaaaatttaaaagagcgataatagtttttatctaaaatcgctctaatataataataaaattatctttcataatctttattaggtgtatgattatcactaatttcttcgccaccatcgtcaacaatttctttatctttttcattaagatttaatttaatattaagttcatctaatcgtttagatttggcttttaattcttcctcttgtggaaatggtttttttatttctaattttgcattttcataattttttttggtatcttcaagattgctttctgcattagaaagtttattttcaatgctatttaatacattgtcaatacgggttatatttccacttggatcacttcctaattctactttatatgataaattatttttcattcccatataaaattttctatcaaaagtatcaaatgataacatcattttaaaccccttatattctcctatttctattggctctggattagtcattgatttacatatttctattattttttctcctgcttcttttctttctatgaagtcttcgcctctaatagtcattttctcaaacgaattatcttctgtattattagaattaaaatactctaaatcttctttcatatcttcaattctattttctaatctttttatttcattaggataatatttaataactttatcttctaatgcatatatttcacttaaatgagtttgttttaataactttaattttgcgacttgtgtatctagttctgtcttttcaattatatctggatttcctgctgcaagtgctttaatttctgcataagataatgcagtttcatcaatatcttcagcaaatcttacaggagtctttgaggtcattatttgagaaataaatctttgtttattttctactaactgatataaatatgcatcaaaagttccctccgttacatatctataaatatctacttccggatttttatttccctgtctaattattcttccactcctttgaattaaatcacttggtcgccacggacagtctaaatcgtgcaatgcaattaatctatcttgacagttagttcctgcccccattttttgagtgctacccatcaaaactcttacttgtccacgcctaactttattaaataattcttgctttcttgcatctgtatttgcatcgtgaataaatgcaatttcttcgtctggtattcctctatcaataagtttcttttttaagtcatcatatacattaaactttccatcattatgtggagttgataaatcacaaaatacaagttgagcagatttattaggacttgttttgttccaaatatcatagatattatctgcacaagttgcaactttacttttatcaaaatcgtctaacatttcattagataatctttggtcaagtgctaatttccttccatcattagttatttttaacatattatcaatagaagaatctaccattctatttcttattctttctgctctttcagatagttcttttacaagttctttttgaatctcactaggctctatgactatattatgatagtttgcttttggtaccggaagattaagcatatcagaagtttgtatatcagcaacttccttaaacattgccataagttctggtaaattaaagaactttgcaaatctagtttttgctctataacctgtaccttctgggcttaattctattgcagtaactgtttcgccaaatgttgaagcccaagcgtcaaattgttgcaaatgtcttttttctaattctccatattgtaaatatctttgcatagtatataactctaccattgaattagaaactggtgtacctgttgcaaaaattactccttttccacctgtaagttcatctaaatatctgcatttcataaataaatctgatgacttttgtgcttcggtttgtgcaatacctccaacatttctcatcttcgtatataagaaaagatttttataataatgtgcttcatctacaaatattctatcaacacctaattcttcaaaagttataacatcatcttttcttgaagtatcatttaattttgcaagttttgtttctaaattcttttttgttttctccatttgcttaatagaaaatctttcgccattactattttttaaatcttgtattccaaatgttatatcatcaatttgtttttgtattatagcaatttgtcgttctactgacattggtattttttcaaattgagaatgtgaaataatgatggcgtcataatctcctgttgcaattcttgaacaaaactttttacgattggcagtttggaaatctttttttgttgtaaccaaaatatttgcactgggatagagttgtaaaaactcttgaccaaattgttcaacgatatgattaggaactacaaataaagatttattacatagtcctaatctttttgattccattgcagcagccaccatttcaaatgttttacctgctccaacttcgtgagcaagtaaagtatttcctccgtaaagaattcttgctattgcatttacctgatgttttcttaaagttatttctggattcataccatcaaaggttatatgacttccatcatattcacgaggtctaatagaattaaatctttcattatatgatttaactaatcgttctctacgctctggatctttccatatccattcttcaaaagcaagtttaatttgttcctgctttgcttgtgctatagccgtttcttttttatttaattctgcaactttttttccgttttcatcttcataataatcatatattctagtatcttttaagttcaaactatcttcaataattttataagcatttgctctacttgttccataagtattagtggcttttacattgtatctatcataacttttcccatctatataccattcagaagtagattccatataatggacatttatatttctacttgcataataactaggatttaaaagatattctataaaaacttttatatcttctggtggtatccaagttgagcctaaccttacactaatttcacttgcacttaaatcttttggttgaacttctttaagatactttacattaatattaaacctatcatcagtttctgcaaatttttctgctattcttaatttttctcttacatttccagaaaggtactcatctgctgtcacccaatgattagactctccatattcaggaacattaaatatttcgccttctaattctttaagcatttcatccatattcttattacaaagttgttgcataaattctatatcaactcttgctttttcagaaagtgaaacaattaaagcgtcgttagcattatctactgatgttatttctgttttaggtttaattgttcttttagtaaacatatctgcttttcttgcaagattaccattttcatctaaaatttcaagagagcataatagataataacttgaatcattagaaaaagcagagttatttcctctgctattgattaatccatatttctttgtaaaagtatcatataaacgatttaatttaatctgctctctctttatatcttcatctggatagtcttctgtctgatactccaaaagagttctcacacagtcccttatttcaataagaccttttactctattttcagttgtcatagcaagttcttgtggatacattctactattctctctgaaataaattttatcatcaattaaggtatatgagaagtttctaacagttaaatctgcttcaatagaattatcttcttcgcctatatcatctagttcatattccttaacttcagcgtgaatatttgaaattgcttcattaagtttttcttctaaatttaagccatcagatatacaagcagaatcataaccaaacctagtagaaatcatttccatatttcccattatcatttctggattatcaatgaaatattgattcatcttaattccattttcattttctcctaaatatacccagtctggctctatatcagttattgaatctcttttttgtaagaatataatatctgatgtgacttctgtacctgcatttgctttaaaagtattattaggtagtcttattgctcctaacaggtctgctctttgtgcaatatatcttcttacacttggattttctttatctagtgtacctttagaagttataaatgcaataactccacctggtcttactttatcaagtgttttagcaaagaaataatcgtgaattaaaaaattgtttttatcatattttttatctaatactttaaaatctccaaatggaacatttcctattgcaacatcaaaaaaagaattaggaagattagtatcttcatatccttgtactgcaacagaagatttttgatatagttgtcttgctattcttccacttattgaatcaagttcaacaccatataacttacaatcttttaatgattctggaatcattcctataaagtttcctattccacaactaggctctaatatattaccggttttaagccccatattctctaacgctttatacatagacctaattactattgggggtgtataaaatgccgttaaagttgattctcgtgcttgtgaatactctgtttcatcaagtaagttctttaaaatatgatattcattactccaagaagaatccatatcatcaaatgcttgtgaaagacctccccatccaacatatttagatagtatttcttgttcttctggagtagcaaatctatcttcttcttcgcatttttttaaaatcttaattgcatcaacattattattaaatttctctcttggagtaccttctcctaatctatcatcagatattctaaactgactacgattgacagtaggtatttctgggtgtatatcaaaacttcttattctattactttttttcttttcaaattctggaacaattatttcttctttttctatattttcttcaataaacgtttctttttgttcctttttcgtatgttcttcagcattattttcttcttgtttttgcttttgaatttcacttattttaactttaagatggtcattagcaggattttctttaacttttttgtcaaagtcttcttttgacatttcacgattaaataatgggtattggtaatcatatagaactatattagaaatcccaatatttagtatttcatattcatctgctccaatataaaccttatcccctaaatgatattgatactcgtattcttcttcagtttgttctaataaaatgttgtctgcaaggtttttacttgcctctataaactctctttcttgttcttctttttcaagccaattaggatattcttctaattcttttttatttaagtatctatcttcgtgaataagcgtttttattctattggcaatataattccacttaaataattgttctttagcactagcatcaaaataaccacgattaaaacgcattccttttgcatcataactaacacctataccagatccttttacagtatgagttgctcctcccataccataagaatttttaagataatttatattttcttctgctgataaacttttttgaaatacctcataagttctgtactttgtttcggtatgttgttcagttaaatatttatctataaattcttgagtaaattctaaatctgataccatcttttcactattgtcatcaataaaacttaattggtctgttatacttggcaaaggctcaattctatcatttaactgatttagcaatatcattgaatcataatgataagttaaatcttcccaacttactaaagtttctgtatctcttgataaaaaattacctttccaaaataaaataccgttgtcaaaagttttataaccatacatcttgtcatcaactataacaccggtataatctgaattaaacatttctttaagaaattctgctcttttgctaatatctttctcattagcaaaataatcttttatttctttgtttgattttcttatatgtggggttgtacttaatatttgatttatcttttcttctactacaacataaggatgatgttctgttgcattataaacatttaagcgtaaatcaattcgttcattactatctcctctgctgacaacttcaagttgttcatcatttgtacccacttcatttggtcttgttgtttcaaactctctgttatattctctttggctttcatctctgatactatttgttctatcctctccattgctgtttgttgaatatgcattaaatgttgtggaagttgattgctcattagtagagttgtgtatagagatttcttgttctctttcaagtatcttaacctcatcattgcgtatttgccctccacttgaatcttgttttccggtactgttaagttcggtacctcgtaatccccttgacgtgtgtaagttatattcattattattcctcctttcaatagtatttctgctttcgcttatatcataagataaattactgtctatatcaaatgtgcgaattttatttatttcattaattcgcagatttttaatggtattatatatttcacgaagtcccatttcagatatttcacttgttgctacaccaattctcgttattgtatcaaaactatcaaaatttaataaatcactaaaatcgctacttgtaaaatattcatttggatttagtccacatcttttaattattgaaaatgcaatactattttctaatgccttttgaaataatacttttatattttcattatctaatgattcaagagaactattttctttatagaatattaaatcatctaaataatcttgtatattatcctcaacaattatttttgataccgacttaattgcaagtcccagagaacttttatcagcaagttctccgtacttattttctaatgactcaataatatctaattcataaggttttgaaactgaccataatctaaaacttttaccaagtttactattggtatctgcaatatcaaatacatatcttaaattagtataaccattttcttcagacaaaagagcaattccttttgcaccacgattaacccatctaccaacttgtttattccaagcctctatttttgcacaggctattgccgtaggtttttgtgcataaattaaaacttgatcattgaaaggatatttgtagttcattgcagcacattccaaaaaagacatccaatcttcaggagaactgcttattttagttaaagtttctccataaaggtctgtaattagtcttaatttacttgccatattacacctcctattctaaattagactatttattcacttgccattttttcttcttttattttttctcttacttgcaacaatacatcaaagtaatttgtttcaacagaaatcatatcctctattccataaaataaaatataaaataaatctactatttcattgttataaagtctaatatctacttttgtttcctcattttcattttttattggaacactatatcttaacaatttttcttttaattttgctgatttttttgaataaagttcattatcagaatttattatattttccaatatctcattaagtttattaaactcatttatgtttagttttattttaattggtggtattctttttgaataagccatatcattttcctcctatctttccatatatttatcttgttttactctttgatttaaaactatattatttctatattgtcctattgcctcttttacagaagtatttttcaatatatcatctacttttgcttgggcttcttttctattttttgcctccacttcaaaagtaatagttccattaatatctacatctatttcaaattttttcattataatgctaaaacaacaacatacgataaaaatggctatgatggtgaattaacagtcacatataagaatggactaataaatagtatttcttatacaaaaagaaacaataaaaatgaagttatcacatcaaacaatgaatttttaagaacattcaaagatacaaataatattaattatcaaaaatatattcaaaatattattgatatgtcaatagaaaaagaaagtattgttctatctaaaaataatttagatatagataaagagtacaacagtcttgcaaataaaataaacgaaaaatcaaaagacttcgattatacaaaatataaaatatttaataatattggagaaagtatttaatatggcacaattatattttagatattctacaatgaatgcaggaaaatcaattgaagtattaaaaatagctcacaactacgaagaacaaggaaagaatgtattattatttacttctgaattggataatagatacggcaaaggttttgttgcatcaagaataggcataaaaaaagaagctattgttttcaatgataaaacagactttaaacaaattgttcaaatgcaggaaaaagaaattcattgtattttaattgatgaagggcaatttttaacaggacaacatgttttagacttaacacaaatagtagattatatgaacatccctgttattgtatatgggttaaaaaatgactctcaaaataatttatttgagggaagtttaaacctacttatttatgccgataaaatagaagaagttaaaacagtttgctggttttgtaataaaaaagcaacaatgaatttaagaataatagatgggaaacctaattattcaggaaaacaaatccaaatcggagataatcaaaattatcttccggtttgcagaaagtgttatggaaaccctaaactataagcaatttaaaaagctcctcttttgaggagctttttatgataaaatgagggaatgatatgaaaatttatttacatatcatttaggggaaattatgaaaaagtttttcaactttttactctgttagtatactattataaattgataccatattgtttttaatgtgaaaattttaagaacattttatgtcttttattctacattttatttagaaaacatatcatatatttttttatatatcgctattttatgttattactcaattaaatatttttagtacaaacatttataaattctttgttatttcttgtctttttcattaggttaattactctttcagaaagctccaagctgtccatagagtttcttcttaaaagattagcacaattaagttcatcttctcttaaaagtaaatcttcccttctcgctcctgattttacaatatcaattgcgggaaatactcttcttcttgcgagcgatttatcaagcacaagttccatatttccggtacccttaaattcttcaaaaatcaaatcatccattctgctacccgtttcaaccaatgcagtagctaaaatcgtaagacttccgccattttctatatttcttgccgcaccaaaaaatttcttaggataataaagactttccggatcaagtcctccagataaagttcttcctgaagatggaacaacaaggttatttgctcttgtaaatcttgtaatactatccattaaaattacaacatcttcacctatttcaacaagtcttttagccctgtctaagaccatttcagccgcttttatatgatttgcagggttttgatcaaaggtagaataaaccacgtcagaatcaatgctacgttgtatatcagttacctcttcaggacgttcatctataagtaaaactattaaatgtatatcaggattatttactcttattgcctttgctatttgtttaagaagaatagtttttcctacctttggcgctgctactataagtcctctttgcccttttccgataggagaaaaaatatctatcaatctggttgaaataatatttttttctgtttcaagatttattcgctcgtcagggaaaataggtacaagcttttcaaaatcttttcttcctacaatactttcaggtgcttttccgtttacctgctctacatataataacgcatcaaacttttcaccttctcccgaaagccttattcttcctcttaccaaatcccctgctttaagtttatactttcttatatgttgaggcgccacatatatatcattttcaccttgaagataattatttgttcttaaaaatccataaccgtctgataaaatatccaaaaccccttcatgagcttctgaatataaagtcatatctttttcatcatttttttgaagtttttgtttttcttcttttagaatatcacttgtctttcttccgtttacaccttctagaaaaagcattgcataatacttttcaccttcttttggaggtcttacctttcctgataaaatatctcctgtcttaattttaaacctttgaacctgacttgcagcaacataaacagcatcttcaggctttttcatatccttaggacgtaaaaaagcaaagccttcaggtaagacttgaacttcaccttccatattaaaactatttgaaattggatctttaagttttgaatatcgtttattttcttcttcttcgtttactttttctaatattaaatcaataatttcctgtttttttaacccacttatttttgtaataccatattcacaggctttttctttaagctctgccacttttaattttgataaatcactactattcataaatacctccgggaaaatgaaaagaataaaaaataaatatataaatctttcgaaaattattattaagatatctactattttactatgataaaaaaaataaatcaatgaaattgttcttatttaagtttttgttaatataatttacaaaggagaatgaaatgtggataggaatcaatattaacaaaattattttttatatactttttttaataatactttattattttacaaaaaaaatattattaaaaagataaattacggattatttaatattctaatctttttttaataaaaaaagtgtatttttttcctttttttttcacaattaaaacaacaaagtatcatagcatacgattatactaaacactgtaaaacaaataagttttacaaatataatttcccctttaattttaaaaatgttatgattttctttaatttaggaaagtatcctttaacaggaagaaataaataacaaaaaaaagaccgtaaggtctttttttatttagtatattctattattaaatgtctgtttgtaccttcatcaacagaataagtcgttatatgttccctaccttgaagatatgaatgaataattcttctttcataaggattcattggttcaagctcaatattttttcttctttttaaagctttagttgcaagcttatctgccaaatgttccaaggtttcttttcttttttctctataattgtttatatcaagaattactctaatataattttcagaactcttatttacaacaagacttgttaaatattgtaaagaatctaatgtttgaccatgttttccaattaatacacctgtattttctatatcaagagaaataaacatattttcatctttttcatcataatcaatgcttatagaatgttcaatacccattttatttaaaacactgtctaagaattcttttgcaatttcatcaaatttttcaattaaaaatacttctactttggcactttttgcacctattcccataaaacctgaagtaggcatttctaaaacttttgtatcaacttcttcgcttgttgcattaagtttttcaagagcatcttttattgcatcttcaattgtcttaccttttcctattgcgctttttcttctttccattagatacctccgtataattacttataggttttacatgtaaagattcagctgttacaggcataaatttatacataatttctgtttgtaaaataccaagtaatgtcgttgctgcccagtatatagcaagagctcccgggaaagttaaagacatccagcctatcattaatgtcataacaaaattcatcatttgcatactgccgcccatttgattaggttggttagccattgattgtttcatttgaataaaagtagctaaagtagtaatcataggaataatcaaagcatataaagtatcaagagaaaatccgcttgttctaacaatatccattgcagatatactaatatcttttaaccagaaaaatgacattgaaacatttgtcattccccctgtaaaaacatataattcaggctgtcttataacaccaaacaaacctaaaattataggaatttgtattaataaaggaagacaaccgctcattggattataattatatttttcataaactttccacatttcttcgccttgtttggctttatcgtttttgtatttttcctgaattttcataacttcaggattgataactttcataatttgtgttgatttgatttgtttgtatgtaagtggaagcaaaataatttttgcaaacaatgcaaaaagaatgattgcaagtccgtagttacctataaaattatagataaacagcaaaacctttccaaataacatatataaatacgacatgttttttcttttttcctcctatagaaatttttccggaaccgggtcgtatcccccttttgaaaaagggttacatcttaaaactctgtatacacttaatatagtgcctttaaaaaagccatgttttttatatgcttcaatagcataatttgagcacgttggaatatacttacaacatggtctttttaaaccagataaatatttttgataaaagattaccagtttagtcatcaatttagccattttcattcacctttaataatccaagttttttaatcaaatgaagaaatgaattattcaatgtttgataatcaatatcttttgcttttactctgacaatgcatattatatcatagccttcttttatttggtatgcatttaacctagaaatttccctaagtcttctttttattttattccttgttactgcattaccaacttttttgcttaccgaaaaacctatcctgctttcattatcggtttttaaaatatataaaaccaaatgtctgtttgcaaaagatttttggttgttgtaaactcttttaaaatctatactgttttttaatctttgcatgatttacccttatcatatataaaaaaaggctacatttacagtagccctagcagttaatatctaagcagataattgttttctaccttttcttcttctatttctgattacattttttccgcctggagtagacattctgcttctgaaaccatgatttttctttcttttatgattgtttggttgaaaagtccttttcataagaatatgcctccttctatattatacttagtccaaattatatcttttcttaaatctatcaactctaccgcctgtatctacaagtttttgttttcctgtatagaatggatgacattttgaacaaatttccacacggatttcgtcttttacagaacctgtttcaaaagtatttccacaagcgcaagtaactgtgcatttaccatagtttggatggattccttctttcatttctttcaccccttttgacaaattattatataaaaataattttatattcttttactatattcgtagcctaataagtatactattttttttacaataatgcaaatgttttttttattttttataatattttttttatcatgcttttacttatgtttattttatggtaaaatttattagcattattataataatataaggtgaaagatgaaaagtaaacaagaaagaacaagaaatttttgcattattgcacatattgaccatggtaaatcaaccttggcagacagattaatagaaaaaacaggcttaatagccaaaagagatatgacaagtcaagttcttgataaaatggaccttgaacaagaaagaggaataactattaaacttcaagctgtaagacttgtttatgaagcaaaagacggtgaagaatactatctaaatcttatagatacaccgggacatgttgactttacttatgaagtatcacgttctcttgctgcatgcgaaggtgcaatattaatagtagacgcaactcaaggaattcaagcacaaacaatggcaaatgtataccttgctcttgaaaacgaccttgaaattattcctgtaataaataagatagaccttccaagcgcagaccctgaaatagcaagaagggaaattgaagattatatcggtctacctgcagatgaagcacctcttatttcagcgaaagaaggaataaatatagaagatgttttagaagcaatcgtaaaagatattccatctccaaaagaaaacaacaaacaaccactaagaggacttattttcgactcatattatgatcaatataaaggggttgttataagtacaagaatagttgacggtgaaataaaaaaaggcacaaaaattagattttacgcaacaggaaaagaatttgaagttgaagaagttggaatctttacaagcactttaactcctgtaacaaaacttgaaagtggagatgtaggatatgtttgtgccagcataaaaaatgttgaagacacaagagttggggacacaataatggatgctcataacatggcaagtgaacctctacctggatataaaagcattactccaatggtttactgcggtatctaccctgctgacggaagcaaatatgaggacttaaaggaagctttgggaaaacttaaattaaacgatgcttctttattatatgaacctgaaacttccgttgctctaggatttggttttagatgcggatttttgggacttttacacttagaagtaacacagcaaagaatagacagagaatataatatagatattgtaacaacaactccaagcgttatatatcatgtaacaaaaacagacggcagtgaacttaaagtagacaaccctacaaatcttcctccaattcaagaaataagttacatggaagaaccttttgttgatgccaatataatgcttccaagtgaatatgttggagctgttatggaaatttgtcaaaataaaagaggcatttacaaaacaatggactacattgatgaaaacagagttaacttaaaatatgaaatgcctttaaatgaaattatttacgatttctttgatacattaaaatcaagaacaaaaggatatgcttctcttgattatgaactacttgattatagaaagtcagaccttgtaaaacttgatatacttctaaacggagaaatggtagatgcactttcatttatcgttcaccgtgacaaagctcaagcaagaggaagacttattgtaaaaaaacttaaagaagaaattccaagacaaatgtttgaaatccctattcaagcagcaataggcggaaaaatcattgcaagagaaaccgtaagagctttaagaaaagacgttttagctaaatgttacggtggagatatttcaagaaaaagaaagcttcttgaaaaacaaaaagaagggaaaaagaaaatgcgtcaagttggtaaagttgaagttcctcaagatgcatttacggcagtgcttaaattagatgaataatatttcaatatatatacacacaccattttgtaaacataaatgttattactgtgattttgcttcttatgcaaatagtgaaaactacattagagattattatgaagcattaggtaaagaaattcttttaaaaaaggaacagctaaagagtagaagtatttctactctttattttggcggaggaactccaagttatgtagacagccaatatataggtcaaatcataaatatcattaaatcaaattttaattttgaagataatgctgaaataacaatagagcttaaccccgaaagtgtaacaaaagaaaaacttcaagattacaaaaattttggttttaaccgactaagtatgggattacaatctgcaaataatgaaactttaaaaaagataggaagaatacacactgtagagaaatttaaagaagcttttctcctttcaagagaagaaggctttaacaatataaatgtagatttaatgttttctctaccgaatgaaaaattaataaattttattgattctttagaatttgtattatcccttaatccagaacatatttctacctattctcttatattggaaaaaggtacaaagctttacgattattaccaaaacaacaatatagagcaaaacgataatttagacagacaaatgtatcattatttaatacaaaaattaaatgaatatggatataatcaatatgaaatttcgaactttgcaaaagatggatatgaaagcagacataatttaagatgttgggacttttatgattatgtaggatttgggagcaatgcttcaagctttaatgataataaacggagtacaaataaagaaaatataaaagattatattgaagacataaaaaaagatactattccaataaaagaagaacatatacttacaaatgaagaattaattggagattatattatgctagcattaagaaaaacaaaaggcttagacatagatgattttaataaaaagtttaatttagattttgaggatatatataaagacaaaataaataaatttaaagaaatgggacttgtacaaataaaaaacaatcatttttctttaacatataaaggactggattttgcaaatgttgtaatgatggaattcatataaaaaaaagcactgaaatcagtgctttttttattttgatttaaaatgaacatattctctttcaacataattacttgtcattgccgcaagagctgcaccataatcaagtttaaaagatattacatcaccaagcttatacatcttatcggcatttgttaaatcaagtatagtatggtcgctgctcgctcccaaaatttctatatcactatcaacaggctgcattccctctgtttttacatcttgtcttcctaaagcaacaattgctcttctcattgttcctttattcgtaaattcaggagtattcccaaatgcatccataccaatttctccaattggaacagaaggtttttcttttaattccactatttgagcttctaaaataaagttatcatgataaagcccctctacaggtttaccataagttgtttcattacctaataatataacttcaccaagtcttagattgtttattccgcttatcatctctccactttcaactaaagtataagaacttgaattacctcctgaaacaacttttaactcaatatcaaaatcttcttcaattctttctttaattttaacaagttttgaaagattatcaggtcttggaataacaccaccaaaacaagtaagatttgttcctattccataaagctcaatatttttaagctgtaatattttatctatatcactatataaatcatcagtactaaaataaccttctcttaaatccccaagatctaccattaaaataactttatgtactttattttgtttatatgcttctttatttaatagtcttattgtttttaattcgctgtttaaagatacatcactatatctgataacatcttctatttcacattccataggaattcttataagccatttttgcatattgaaacaacttaactttttaagattttcaattctggaatcaccaaatgcatttgctccacctgtaacaaaacattctgcaatattctcgtccgccaaaaacatctttgttacagctgttacattaataacgtactttgcacatttttcacatacttttgaagtattctcccttattcctgctaagtttattttaattttgggaaacataatattactccttttatataaagttttataaatttttttcaatcttgtttcaataccatgttataatatgttaatatattacagtatagatattattatatcaaaaaaaaataaaaaaagtaggttattatggataaattattaattaacaatgaaattggtaagttaaaaaaaatattacttcatagaccgggctttgaacttgatagaattacacctgacgatctaaaagaagttttatttgatgacatcccatggatgagcagaatgagaaaagaacatgacggtttcgcaaatatcctaagacaaacaggaacggaagtattatatgtaacagactgtttacttcacgttataagtaataataagcaggcaaaagaagagcttgttgatattgtattaagagaagtacaatatgacgatataactgttatgggacttagggaatttttattaagccttgataataaagaacttataagatgtgttattgcaggacttagcgaaagcgaaataaaatcaaatagagttacattatctgattatatgcaagataaatatccttattattttaaaccaataccaaatctttacttcatgagagatgtaggggttgtaataaaaaacggtgttgctttttctaaaatgagaactcatatcagaagaagagaaagtttaataataagacttatttataaatatcatcctgatttttcaggttcccctgtatattttgacaacgaaagagagagaatgacacttgaaggcggggacgttcttattttaagtaaagaatgtgttcttgtaggtttttcagaaagaacatctcttgaaggaatagacaggcttgcacaaaatcttttaacttcaggtagtggagttaagaaagtattagccgtaaaaattccacatgaaagagcatttatgcatcttgatacggtatttacaatggtagactatgataaattcataatcttccctaatatattaaaagacattgaagtggtaagtataacagcaggagaaaaaaatacattaaaatacgaacaagaagaaagcttaaaaacagcgcttgcaaaagctttaaatcttccaagcgtaaaacttataaaaagcggtggcagcagcagtgttatttcagccagagaacaatggaatgacagcacaaacacacttgccatttcccctggagttgttataacatataacagaaatgaaatttcaaacgaaatacttgacagaaacggtattaaagttctttcaatagaaggaagcgaacttgtaagaggaagaggcggcccaagatgtatgagtatgcctttagttagagaagacatagatttttaggaggaacaaatgagcgttaatttaaaaggaagaagttttttaacacttagagactatacaacagaagaaatcaaatttttacttgatttggcaaaagaacttaaagcaaagaaaaaaagaggcgaaatcggtgatttactaagaggtaaaaacatcgttttactttttgaaaaaacatcaacaagaacaagatgtgcatttgaaactgcagcatatgacgaaggtgctcatgcaacattcttaacaaattcacaaatgggtaaaaaagaatctttagaagatacagcaaaagttcttggcagaatgtttgatggtattgaattcagaggttttaaacaagaaacagttgaagaccttgctaaatattcagggattcctgtttggaatggtctaacagatttatatcatccaacacaacttcttgcagatgttcttacaatgtatgaaaacattgataaagacaacaacaacgatatgaaacttacttatgttggagatgcaagaaacaatgtatcaaattctttactaataggatgcgcaaaacttggaataaattttgctgcggcagctccaaaatctttatggcctgatgaaaatctagtaaaagaaatggaagaaatcgcaaaagaaaacggaagtacaattcttataacagataatgttgatgaagccgttaaagattctgatgcaatatatacagatatttgggtgtcaatgggtgaagaagataaatttgaagaaagaatcaatcttttaaaagattatcaagttaacatggatatgcttaaaaagacaggaaatgaaaatgtaatattcttacactgcctaccttctttccatgatttaaatactgaaataggaaaagatgtttatgaaaaatacggattaaaagaaatggaagtaactgatgaagtattcagaagtaaacattctaaagtattcgacgaagcagaaaacagaatgcatacaattaaagcggtaatgtgtgctacgctttcagataaattatatgaataatataaaaaagaacagctaagctgttctttttttattcttcaatattttcttcttcttcatgagttcttccaagaacttcatctaatactaagttttctataatcttagcagtttccggattatctttaaggaattgttttgccttatctcttccctgtcctattttttcatcttgataagaataccaagctcctgcctttttgataataccgtattttgccgccatatcaactatatcgccttctcttgatattccttttccatacataatatcaaattcagcaattttaaatggtggtgcaactttattttttacgactttaacttttgttctgttgcctataatgtcttgaccgctttttattgaatcaactcttctcacttcaagtcttactgaagaatagaattttaaagctctacctcccggagtaacttcaggattaccaaacattacccctactttttctcttaattgatttataaatatagctgttgtatttgatttatttattgctcccgcaagttttctcaaagcttgagacataagtcttgcttgtaaacctacatgactatctcccatatctccttcgatttcagcttttggaaccaatgccgcaacagagtccacaactacaacatcaattgcagaacttcttacaagtgcttctgttatttcaagagcttgttctcctgtatcaggctgagaaacaattaattcatctatattaacaccaagagcttctgcatatacagggtcaagagcatgttcagcatctataaaagcggcaactccgccggctttttgtgcttctgcaacaacgtgtaatgccactgttgttttacctgaagactcaggtccgtatatttcgataattcttcctcttggaagtcctcctaccccaagggcagcatcaagagaaattgaagatgtagaaatggtatcaatggtaacagccggtttgtcaccaagcttcattatcgcacctttcccaaaactactttctatatttttcattgcaagctctaaggctttttctttatctggattcatatcttaacgtcctttcaaacatttgttcttttatattatacaattactttaaaaattagtcaatattttcatcaattatttttaatatattattaattgcataatatgcgcttcttgtttgaactctttttctttcacctgttatgttgtaaagttttgaagttacttttccattataataaaatcccatatacactgttcctacaggtttttcttcacttcctcctcccgggcctgcaataccgcttatggaaattgcaacatcagtgttaaaacatttggcacatcctacaaccatttcttctacgcagtttgcacttaccgcaccatacttctttagagtttcttcttttacaccaagaagggagtgttttacttcgtttgtatatgtaactgcactacccataaaaacttcacttgctcctgcaatttctgtaatataacttgcaagaagacctcccgtacaagattctgcacaagaaaaagtaagtcctttttcttttaatgttgcaattaatttttgaggaagagtttctcctttaacagaataaatatattctttaaagttacttgttattattttatctaccttgtctaagttttcaacagcatgctttaagttatcagcttttgaaacagctttaacttttacaccgctgtcattaaagtatgtatttacatttactccttcaatatcaggaagcaaatctctaagtttatattctatttcagattcaccaatacctgaagtcatataatcttttacggcaaagaatttatttaatttattaaccaagtattctttaatatgtttataatacatatttgtattttctcttggtggtccaggaagcataataatcattttatcttcaatttcaagaagcgctccgggagcagttcctctgtcgttatctaaaatttttgctccttttgggaataatgcttgtctataattattaggtgttaaaacgtaatcttttccttttctgataaaataactttcaacgtgttttcttgcttcttcattctcttccaaaggtctgtttgtaacctttgcaatggcttcttttgtcatatcgtccaaagttggtccaagacctcctgttgtaatgataacatcacttaatttaaccgcatccataaatgcgccttctaccatatcttcgtcatcacttacaaccacatgtttaacaacttcaattcctatttcagtaagttcttttgcaaaaaaagtaccatttgagtttaatacatctccacataaaacttcatcgcctatgcacattattgtcgctttcatattttctcctttaacacataaatttacattgctattttaaattatactatttaaaaattcaaaattacagtatatataattaaattattcattatttttataaaaaaaagactctattaagagtctttttattttaatattttctttagatattgtcccgtataactatttttaactttagcaacctcttctggtgttcccgttgcaataacttcgccgccgttatctcctccgtcaggacctaaatcaattatataatctgcacattttataacatcaagattatgctctattataagaatagtatttccaccttctcttaacctataaagaacttcaaggagtttttttacatcttccatatgaagacctgttgtaggttcatcaagaatatataatgttttgcctgtttgacgttttgataaatatgttgcaagttttattctttgagcctctcctcccgatagagttgtagaaggttgtccaagttttatataaccaagccctacatcataaagagtctgtacttttgatttaattgaagggatattttcaaagaaatcaagagcttcttcaacactcatatctaatacatcggcaatggtttttcctttatattttatctgtaaagtttcatcgttatatctttttccgccgcagacttcacaaggaacataaacatcaggtaagaagtgcatttcaatttttattattccatctcccttacaatgctcacatcttccacctttaacattaaaactgaagcgtcctttttgataacctctcatttttgcttcattagttgatgcaaaaacatctcttatcatatcaaacattcccgtataagttgcaggatttgaccttggcgttcttcctatcggagattggtctatgtctattatcttatcaagatactctgccccttttacttccttatgttttcccggtctttcaagggaaccaagaatctgtttccttaaagatttaaacagtatttcatttacaagagtactttttcctgaacctgaaacacctgtaacacaagtcattttaccaagttctatcttaacatcaatatttttaaggttattttcctttgcccctattatttcaagatactgaccgtttccttcttgtctttgttttggaacctctattttctttcttccagaaagataatctgctgttatagagttcttattatcaatgatttcttcaagaggaccgcttgcaacaacttctccaccatgaattcctgctcccggacctatatcgactatataatccgactcacgcattgtatcttcatcatgttccactactattaccgtatttccaatatctgttaaatcacgaagtgtctttaataatttatcattatctttttgatgaagccctatacttggttcatctaaaacataaagtactcccgtaagttttgaaccaatttgtgtagcaagtcttatcctttgactctcaccacctgataaagttgatgctgctctgtctaaagtaagataatcaagtccaacatctattaaaaaccccagccttgattttatttcttttaaaataagttctgcaattttagcttcgttttctgttaaagttaaattatcaataaatttcttacagtcttttatcgacatttccgtaagctcaattatgtttactccgtttatcttcactgcaagagagtttggattaagcctttttccgtgacatgaactacaagttatatttgataagaatttagcaaatttcgcttttatatattcactgttgctttcaaaatatcttctttgaatattgtttattattccttcaaactctacttctctttctttgtatcctccaaaatgagaattaaatcctattttaattttgcctttatctccatataaaagagcattcataaattcatcgcttgcttcttttaaaggtttatccatagaaaaattatacttatcaactaacgtttttattattacagaataataagtactgtcatctgaacttataaagttagaaagagcaccttcttttatagaaatatctttatttggaataacaaggtctggatctatggtttgatgatatcctataccattacaatccatacacattccaaaaggagcattaaaagagaagtttcttggttcaggcttttccattgcaattccacaatccatacatgcaaacttttccgaataaagtttatcttcatcattaaatttacaaactaccaaaccatcagtaagttttaatgccgtttcaacagaatcattaagtcttgattttattccttctcttattttaagtctgtcaattacaacgtttatgttatgttttttattttttgaaagttttattgaatcatcaaggtcgaacatttccccgtcaataaatgctcttaaatagccatctttttttaaatgttctattaaatttttatgagttcctttttctcctcttactacaggagccaatatttgaacccttgtaccctcttcatgagataatatatctttaataatagtatctatactttgactttctatttttttaccgcattttggacagtaagggatacctattcttgcatataaaagtctgaagtaatcatatatttctgttactgttccaacggtagaacgagggtttctgtttgttgtcttttgatcgatagaaatagaaggacttaaaccttctatgctctctacatctggtttatttgtctgacctaaaaattgtcttgcatatgcagataaactttcaacatatcttctttgtccttctgcatatatagtatcaaaagcaagagatgatttaccggaacctgaaagtcctgtaaaaacaataagtttatctcttggaattgttaaatttatattttttaaattgttttctttagcgcctcttataacaattttatctgacattgtcccctccttttttacattaaactgatattatcataaaaattttttatttacaataatgagaaaaattttccttatttctttttatttttcccctataaaatataagaatgtacaaagaaataaatcaatgtacattcaaaattttattttaatatatcgctgttttttatgctttcaattgcttttttcatctcatcttcatcttgaacaagtgccattctcacatgcccttctcccgatggtccaaaagcacttccgggagtaaccaaaactccggttttatcaagaagttctatacaaaatttctctgaagaagtatacttgcttggaatctttgcccatacaaacattgttgcaggacatctattcattttccatcctatttcatttaatccgtcacaaagaatatttctcctgttttcgtatgcttttcttacggtttcaacacaagattgatctcctgttatagcagcaattgccgccttttgaacaggtaaaaacataccataatccatatttgactttaaatttgataagtttttaactacttctttattaccaatacaaaaacctacccttgcccctgcaagtccatatgtttttgacaaagaattgaattctacccctacatcttttgcaccttcataacaaaggaaacttccacaggtattcccgtcaaaaaccaaatcgctgtatgcattgtcatgaagaacaataatgtcatatttttttgcaaaagctattagctttttatagaagctgtcaggcgccatagctgttgttggattattagggtatgaaactaccataaacttagcttctcttcttatatcctccggtatctcgtctaaatcaattatataaccattctcttctctttgaggcatatagtatagctttgcccctgcaagtcttggaccgtcggcaaaaacaggatagcatggatccggaactaaaacagtatctccaggattgactattgaaagtgctatatgagcaagaccttcttgtgaaccaagtaaagatgtaacttcactttcaggatcaatatcaacgccgtatctatttttataccatactttcacagcctgttttaaatcttctttatcatttaaaggatacaaataactttccaaattcccggcttgttttattaaagcatctacaatatgctttgcaggcggaatatttggagcgcctacgcttaaatcaattacatgcattccctcttttattttttcttcttttaaatgagcaagtttggaaaaaatcccttcttggaacatatccattctatctgcaaacttcattattacccctcctattcagatacttgcttcaaaataatatagcaaaatatatgccatatctatgtattatattcgttttttttaataaagtccactaatgcacaaatttaatcaaatttttttatgatataatataaaagaggtaataaaatgcaaaataaaaacatagaaaaagctctgaaaattgcatataaagcacatgaaaatcaatttgataaaggtggaaagccctatataaaccatcctattcatattgcaaaaatgctaaattgcgaagatgaaataattactgcacttttacatgatgtaatggaagacagtaatattacaaaaaaagatttaatagactttggctttaatgaaaatgtaataaatgctttatcttgtttaacaagaaaaagaaatgaagattatttttcttacataaataaagttaaatcaaatacactagctaaaaaaattaaaattttagatcttgaacataatcttgatgtaaaaagattatctaaaattacaaacaaagatttacaaaggatagaaaaatataagaaagcacttgccatattaaaaaaagaccgctaaatcggtcttttatattgaataaaatcctaatacttttaatccgtattcttttctaatgttttccaaagatctttgtacaatttccatctgattggaatctccattaatctccaaataaaaattatatttccccatatctgtctttgttggtctagacattattgcaaccaggtttattttatttatagaaaactcatgtaatatatcaaaaaggattccgggtctatctatatttggcataatatacattggaactttaaaattcttattttcttgagccgcatattcattttcacctttttccacaacaacaaatcttgtaaaattattagatgcatccgttacattttctattttacatttagcatttgcatattttagcatatgcataggtattataccgccttctgccaatatccccttacttacgttattataagattccatattactgtcggttgtaataatatttacatcatctaacgaatctaaaaactttctgcattgaccatttgttttaaattgtacatatattttttttatttgctcgatattttcactgttacctataaaagaaaactgaacaggaacacttatttctcttacaatatgaacatccatttcaagaagtaaatcaagcgttctttgaacgaatccatcaagtgtattttctattggaattattcccatatcgcattctttaccaatgctgtgaaaagtttcatcaatggtattataatatactacatcaaaatctccgttttcttcatttaaaaataaactgcaagcattatcgctgaatgttccctttggtccaagtactgctaattttctcaaattctttctccatattttttaattaccataaaaaaggatatcaaaaatatacattttattcaatagcaagtaaaataaaaaacatccataaggatgttttttattttacttttactttatatacttttgagaaagaaccttttgtacttccgtttacggctcttactttgtagtaataagttttctttgatgtaagttttttattcacatattttgttgatttcacagttgcaacttttttaaatcctgttgatttatttgttgatctgtaaatttcataatattttgcatttgaagcttttgaaattgtgattgttgcacttttctttccgctttttatttttaatgaatttacttttccaactgtaattttcttttttggtagattaactttaacattgcaatatgctattttcccatcttttgtttcagctttaataacagcgcttccgtctgcaacaggtgtaattttaccattttcaacttttgcaacttttgtattgctactgctccactgtattgtcttatcatctgcatttgaaggataaacttctcctgttaaatatacaacatcagtcaatttatttaattgtacatttgttttatttaatgtaacactttctgttttaactttatttacattaatactgcaaaccgcaataatatttccattttctttagaaattgctttaacttttgtatttcctgaattttgagctgttacaactccattttcatctacattagcaatattaatattttcactttcccattttacatcttgatttttagcatctattggataaattgatgcatttaattttacagtatcgtctacatctaatgttacattttctttatcaagagaaatacctgttaccttttttggtgaaacatttacttcaactgtttttacaatattatttactgtacttgcaataattattgttttcccttctttaattgcttttattttaccattattatcaactgttgcaattgaaggattaatgctttcccattttactgttttatcagttgtattcttaggcaaaacttcatatgttacaactttttcttcatctttaaataaatttaaagtactgtaatcaagtcttaaagaacttgccataacaggttttacactaacttcaaaagatgtacttacaccatttcccatgttaactgttattgttgtagtacctactttttttgctgttagtttaaagctgtttgaactgtagaatgattttggatatgatacaatatcttcatttgatgatgttaaagtaacgtatctgtctgtagtatttgaaggtaaatatttaataaagtaataatctccaccacccatgtaaatactttcaggacctattacattaactccattaattttaacttcatttacagttactttacattctgcttttttaccgtttgctgtcattgcaaaaatagtacctgtcccaacccctgaagaaacaacaacaccatctgcatctacacttgcaacatttttatcagtactgttccagtaaattaagtctttatcatatgacgcaggctcaatcgctgcctctaatttaaatgattctcctataccgtttaatactaattcatctttgttaaatgtaatatttgtagcattaacgttttcttcgttagatgcataaatagggggtataatactaaatactagcatcactgtaagaaatatacttaatattcttttcatgattccctccactttttttcaatatgtttttcaaaatttttcatatcctaccatatctgtaggaaaaagcaaacccactttttcaatttaaaaatattcagactatttatattttcgtaataaaaaaagaacagccataggctgttcccatatatataatatattatctttttgaaaattgtggagcttttctagctttcttaagaccatattttcttctttctttcattcttgagtctctagttaagaaacctgcttttttaacttcttttcttaaatcagggttttctgcaactaaagctcttgaaataccatgtctgattgctcctgcttgaccagaaattccgccgccgtatacatttacgcttacatcatatttgtcagcgttgtctgttaaaactaatgattgtctaacaattactttaagtgtatcattaccgccgaaatattcttctatatctctaccattaatagttatctttccactaccttgttttaaaactactcttgcaacagaattttttcttctgcctgtagccataacttgttctgccatctattcctcctacttaatatcaagtacttcaggtttttgtgctgcatgttcatgttcgctacctgcgtatacttttaatttcttaaattgagctcttccaagtttattttttggaagcatacctttaactgctttttcgattacaaattctggtttattagcaattaaatctttgtacattacttcttttcttccaccaggatatcctgtgtgtctgtaatattttttgtctaataatttatttccagtaagatgaattttttctgcattaattacaattacataatccccagtatcaatattaggtgtgtaacaaggtttgtttttacctgttaatacttttgcaacttcactacataatctaccaagtgttttgccttcagcatcaactacataccattttttatcaatttgttggggtttagcaatactagttgactttgttaacatttcgttaaacctccacaatacgtataatatttttattttagattatctgctctacactttccatgcacggggctaacgatacacgaaaaatatctagcctatatattttagattattttaccttttatgtcaatatatttttttataatatgtaagtttttagtaaaaaacttcctttaaataaagcccttccgcaggtgctgtaacatttgccatgcttctgtttttactttctaagatttcatctattctattttcgtcaaatcttcctcttcctatatcaattagacttgcaacaatgattcttaccatattatataaaaagccattaccttttattttaaaaataattaaatcatcttttttagttattttaacatcatatatttctcttatggtacttttaacattactgccacttcccataaatccagcaaaatcatgctcaccaataagtttttttgaggctctagtcatcttatccaaatcaagtttataaaaaacatgagttgcccttcctataaaaagaggattcattatactgttattataaattaaatacatatattctttccctgtggtatcatatctggcatgaaaattctcatctttttcttctgcctttattacccttatatcttttggtaaaaatgcattaataccataaggaaatttatctatggatatattagaatttgtataaaaatttgctctttgccctaatgcatgtactccgctgtctgttcttccacttccgtaaagtttaacctcttcttttacaagactttcaacagctgtctttactttctcttcaacactcattccgttattttgcatctgccagccaacataatttttaccgtcatattgtattgtaaggactatatttttcattaaataatccccttagtataaagaatatttgttactactgtaaaaattatcatgaatacaatatataaataagtataaaaatcattttttgtatactttaattctttcattcttgttctgttttctccgccggtataacaccttgcttccattgcaagagctaaatcctctgctctttgaaaagcagataagaataaaggaattaaaaccggaataaaagcttttgctctgtttataagatttccgctttcgaaatctgcaccccttgatttttgggcattaataatccttgttgtttcttccataagtgttggaataaatctaagtgcaatactcatcatcatagatagttcatgtgcatatttttttaataaaggtacttttttcattagtctttctaagccatcagtaagagatataggcgatgttacaagtgttaataaagaagtacccgtaacaagcaaaacaagccttacagccattaatatggcgttatgaagtcctttatcggtaatctttaaaaaacctaattgatatattacattaccgggtgtcataaacatattaagacaaacggtaaataaaataataataatcagtgcttttaaacctctaagaagatatcctaccggaacttttgaaataattaaaggaattaacaataaaataaacattcccaaaaatccaataaaagatttaacaaaaaaaagtaaaatcatatacaaaaaagtagccattattttacttctcggatctaatttatgaatcatcgatccggttggataatattgtcctattgtaatatcatttaacatatttatccccttaaataactttttctatttcttttattacttcattaaatgtaaataagtttgtatctacattaattcctttttctttaagttttaacataagttcttttccttccggaacatttaaacctatgcttcttaaaagttcaacatttttaaaaacttctcttggtgtatcataaagttttaattctcccgaagaaaacaccattattttacttgcatattcacatacgtctgtcattgaatgagatactaaaaaagttgtcaaattattttctttatgaagtttatatatattatcaagtatctcttttcttcccactggatcaagtccgcttgcaggttcgtccaatataagtacatccgggtccatagcaataacaccggctattgcaactcttcttttttgacctcccgataaatcaaaaggagatttatctttataagtttcaaaatccaacccaaccatatccattgcttttcttactgctccgtcaatatcttccatgcctatatttttaggaccaaaagcaatatctttatatattgtttcttcaaataattgatattcaggatattgaaatacaagacctacttttgagcatatatctttcattaatacgcctttttcatttatattaagctcatctaaatatatatccccgcttgtgggtgttaataacctgtttatatgttgaatcaaagtggattttccgcttcccgtatgacctataattccaaccaattcaccattattaacttcaaaatttatattttttaaagccttaaactcaaatatactgtcttttccgtatgtatgacataaatctacaacttttactgacatatttcctccactaattcatctaacgtaaggattttatcattttttatttttccttgtttttttaactcatatgcaactttagtagcatatggaggttcaagcattagttcttttaaaatatcatcctttgcaaaaacttcccttggttcatcttcaaggacctttactcctctatcaagaattattaccttgtctgcatttactacttcttccatataatgcgttattaaaacaatggttgtacctttttcatttaattttttgattgtattaattacttcatttcttccttttgggtctaacatggctgtaggctcgtccaaaataatacattcagggttcatagcaagaattcctgcgattgcaatcctttgtttttgtcctccggaaagttcgtgaggctttttatctttaaattcgctcatgcttacgcttaaaagagcttcatcgactctttttcttatttcacttggctcaacccccaaattttcaggtccaaaggcaacatcttcttctactattgttgcaaccatttgattatcaggattttgaaatatcataccggctttttgtctaatatcccatatctttttttcatctttggtattcattccgtcaattaaaatatcgccgctttcaggaagtaaaataccatttaacaattttgcaagggttgattttccggaaccgtttcttccgattataccaacaaaacttcccttttcaacacaaaaagaaacatctttcaatgcttctacaatcgtttttccttcattatccttataagaataattaacgttttttatttctatcatttcgctcatattttttctctcttatatatattataaacttacacaatttcaaattatacaaatttataatatatattatatagagctaaaggaacagtgcttatactgtccctttgtactatattttattagattattcacttactaactctaaaatcgctgtttcagcgccgtcaccacgtcttgcaccaagtttatagattcttgtgtatccaccgtttctgttttcatactttggagcaatttcattgaataatttatcaactacacgtttgtcataaatgtaagcaagagcttgtcttctagcatgtaaatcgccacgtttacctaaagtaatcattttatcaacgatttttcttgcttcttttgcacgaaatagagtagtgtttattctttcatatctaagtgtatctgttactaaacctcttagcatagcttttcttttatcactagctttaccaagttttctatatcctgacattataaacctcctttattagtgtttactattcatcaccttgtctaaatgataaaccaatttcggcaagtttctttttaatttcatttaaagatttcttacctaagtttcttactttagacatatcttcttcacttcttgaaattaattcttcaaccgtatttatactagttctctttaagcagttgcttgaacgaacagaaagttctaattcgtcaattgacatttctaaaactttttctttttcgttttcttctctttcaaccattaaactagcatttggtaaatttgcattcatatctataaataattgaagatggtcattgattacttttgctgcaagtgaaacagcttcttccggagaaatagttccgtctgtccaaacttcaatatttaatttatcataatcagtaacattaccaactcttgtattttcaacagtaaagtttgctttctttacaggtgtaaaaatactatccaccggaagtgtacctattggcatatcttcctttttattcttttcgcttggaacatatcctgtaccgctatcaatagtaatagtcatatcaagtacagcatcattcataagtgaagctatatgcaaatcaggatttacaatttcaacatcgctatcgcaaattatatctcccgcagttacttctccttctccttcagcgtgaatatgaacatccacaggtccatcagaatgtaactttacagatagttcttttaaatttagaataatttgcaatacatcttctgctacaccatcaactgtagcaaattcatgtaatacattttcaattttaatgtttgttacagcagcaccaggtaatgatgataacataattcttctaagagaattaccgattgtcataccatatcctctttcaagtggttctacaacaaacttaccataagttctatctgcactaatttccgcaatctcaatattaggtttttgaaattctaacatatataaaacctctcaattccttaaatataaccaacaatatatcaaaactatatcttatctagaatataattcgacaattaaaatttcatttacaggaacatctattgcttcacgtttaggaagttctttgatagttccgcttaatttttcaatgtctacatctagccattcaggaactacacgtgaaccagtcacttcaacaatttctttatatcttggagattttttatgtttttctttaatttcgataacatctcctgcttttgttaagtatgatggaatgttaacttgtttaccgttaacaagtacatgtttatgatcaacgatttgtcttgcttcacgtcttgttctagcaaatcccatacggaaaacgatgttatcaagtcttgattctaataaagtcattagattttcacctgtagcaccactcattttttcagcttttttgtagtaatttctgaatggtttttctaatactccgtaaatgaatttcgctttttgtttttcacgtaattgaagaccgtattcgcttaaattaccagatctttttgcttgtctgtttgactttttatcaattcctaaatatacaggatctaaatctaaagatctgcatcttttaagaacaggaactctatctacagccatattaattttttcctcctacaaattttcaattctttataatacaaatttaactaacccaaattagactcttctacgtttaggtggtctacaaccattgtgagggataggagtaacgtctttaattgaaataacgtttagtccagcagcttgaagtgctctgattgcagcttctctacctgaaccaggtccctttacaaatacatcaacagtttttaaaccatgttccatagctcttttagcagcttctgttgcagctgattgagcagcatatggagtactttttcttgaacctttgaagcctaattctccggcacttgaccatgccaaagcattacctgcaacgtcagttaaagtaacaattgtattgttaaaagtagagcgaatatgcgcttgtcctttttcaatgtttttcttaactctcttttttcctcttctaactactttctttgcagccaattttaaatcctccttaatttgtgagaataataatctatctatttatttatttttttctacttacagttttcttaggaccttttcttgttctagcgtttgttttacttttttgacctctaacaggtaatcctctacgatgtctaagtcctctgtaactaccaatttccattagtctttttatgttaagtgaaacttctcttcttaagtcaccttcaacagttacttcttcatcaataagagcacgaagtttgttaacttcatcttctgttaaatctttaactcttgtatcaggattgattcctgcttttgccaaaagattattagaagtagcttgaccaattccgtagatataagttaaacctatttctactcttttatctttaggtaaatccacgccggctattctcgccatcaatcgcacctccgtatgattttttaagtttaatgtttaactattattttctaaaaatttatatatataaaagattttgtcagataaattccagccgcgacaaaatactttataccaaattaattaaccttgtttttgtttgtgtttaggattttcacaaataaccattactttgcctttacgtttaataactttgcatttttcgcaaataggcttaacactaggtcttactttcattattttttcctcctactatatagtaattttatttacctttttctctccaaatgattctaccttttgttaaatcatatggggaaatttctaaaattactttatctcccggtaatattttaatgtagttcattcttaattttccagatatatgtgctgtaatttcgtgtccgttatccaactttactttaaaagtagtattaggcattgcttcaacaacaattccttctgcttccacataatcacttttactcacttaaaacacatcctcctacaattcttctttaattctctcaatttcttttctaataagtgcattgggaattttttcattacattttattttatcacaaattaatgtactttttacatttattttggaaatatgtttaattttttttagtttcggcttttctatttttcttgattttccatcagcaagaaaaaccattttatcatccaaaacaccaaccacaattagaaaacttgctttatctcttccggcttttgataacaccaaatcgcctatttcatatttcatatttcaccttataataaagttaaaattatgggttcaccatccgtaacagctacggaatgttcataatgggcagaaagtttaccatcatcggtaacaactgtccaaccattatccaaaacatgaacatcgtatgttccttgattaaccattggttcaatggctatagtcatacctttttgaagtcttggaccttttctcattccaacataatttggaactgaaggatcttcatgcatgttttgtccaactccatgacctgtataatctctgaccaaactaaaaccataactttcagcgtaatcttgaatagctcttgatacatcacttattctgtatccttcttttacgaatttcaaaccttcataaaagctttgtcttgttacttctacaagtttttttgcctcttcagacacattgcctaccataaaagttttcgcttgatctccaacataaccttcataagtcgctccgatatcaacactaactatatctccatctttaatgataacatctttgcttggaattccatgtacaacttcattattaactgatgcacatatatttcttggataatccatatatcctttaaatgttggtatagcattattagataagataacatcttcaactatcttatctaattcaagagtgctcataccaggtttaatatatttttttacagcttcatgagcctttgctgttatctttccggcttttttcataagctctatttcatgatttgattttaatataatcattatttacactcatcaagaatttttgaaatatcttcaaatacttcttcaactgttcttgacccatttactgtttttagtatattttgttttttataataatctactagaggttgtgtcttttcttcatattctttcaatctttttactacagtatcttctttatcgtcgtctctttggtataattctccaccgcatttatcgcaaatacctgcagtttttggtggttgaaattctacatgataagttgcaccgcatttgcacattcttctgccagtaattctctttgtaagtagtgaataatctgcttcgatacaaagggccaaatctaatttttcaccatttttttcaagaattttatccaaagattctgcttgagaaattgttcttgggaaaccatcaagcatatagcttccttctatatcatcccaagataatctatcttcaaccatttcaaccgttacatcatcaggaacaagcaaacctttatccatatattcttttgctttttgaccaagaggagtattttcacttaaattttttctaaaaatatctcctgtagaaatatgaactaaattatatttatcaacaatcttgcttgcttgtgtgccctttccagctcctggagggcctaaaagtattaatttcattttaatcacctactattttaagaaacctttgtagtttctcataatcatttgttgttctaattgatttacagtttcaagagcaacacctacaacgataagcaaacttgtaccaccgaattgtaaacttaaatccattacattacctacgataataggaagtacagctataacaactaggaataaacttccggcaaccataagtctgtttaatgttctttttaaataaacaatcgtagaatgaccgggtctgatacctggaataaatccaccgtattgttttaagtttttagcaacatcatcaggattaaatgtaacaatagtgtaaaaatatgtgaagaatattattaacactatataaagtatagtagaagctgttcctccccatgctaaggctttgcttagccatgctgaaaatccccagttagggaagaaagatgcaagtgttgatgggaacattgtaattacactggcgaagataataggcataacccctgattgatttatctttagaggaatatgtgtattttgtccaccatacatttttctaccaacaactctttttgcatattgaacaggaatttttctaactccttgatttatttctacaactcccgctacaactaaaatagcgaatactaagaatagtataagcattactgaactaatcgcaccagaagttacttgttcatacaagtaacctaaagctgatggaatattagctataataccggcaaagataagaattgatataccattaccgataccatgttcagttatattttctccaagccacattaagaatgttgtaccagctgttattgcaagtgcaaccataaccattgcaagtgctgaatcactagttaaaatttctttaaaactaaatgaaattccaagtgcttgaattaatgccaaaacaacagtcaaatatcttgtataagaagagattttctttcttccttcttctccttggtgagaaagtctctctaacgccggaatagctattgtcaataattgcaaaataattgatgcattgatgtaaggtgtaattgacatagcaaaaatagaaaatgttctaaagttattaccagagataatatttaaaagtccgaacattgaattgttatttaccattgagtctactgcagctgtatcgataaacggaacggttataaaaccgccaagtctaaagatacaaagcatagcaagtgtaaataaaattctttttcttaattctgggatattccaggcatttttgatagttgtaagcattctattatacctctactttcccgcctgctgcttctattttttctttagctgatttacttactttatcaactttaacagttaaaggaacagtaatttctccgtttcctaaaactttaacatattcatatttatttttaaccatacctagttcttttaaaagatcattagttacaacgctgtctttttcaatttcatttaatctgtcaagattaacaacagcaaattcttttttgaaaggatagttagagaaacctcttttaggaactcttcttgttagtggcatttgaccaccttcaaatccaggtcttactccgccgcctgaacgtgatttttgtccgtcttgacctctacctgcagttttacctctgcctgtagctgtacctctaccttttctaatagtctttcttgttgaaccttcagcaggttttagctcgtgtaatctcattattgctaaccccctattatatttcttcaacgtctaacatgaagtccattttttgacaaatacctctcatttgaggattatcttgttttacaacgctttgaccgatttttcttagtcctaaagcttcaatacttcttctttgtttttcatttctacctattaagcttttcttaagcgtaatctttaattgtttttctccagccaattctctcacgctccttatcctaagatttcttctacagtcttacctctttttttagcaacttcttcaactgttactaaaccagataaacctgctaatgtggcttttaccatgttgcttgcattgtttgaacctaaagatttaattctgatatctttgattccagcaagttcgattactgcacgggcaggaccaccagcgataactcctgtacctttagcagccggtttcattaacacttttccggcaccaaatcttccgattgtttcgtgaggaattgttgtgcctgataaagaaacttcaatcatgttctttttagcatcagcaataccttttctgattgcttcaggaatttcaatggctttaccaaggcctacacctacgtggccgttttcatcgcctactactacaagagtactaaaacggaaatttctaccacctttaacaacttttgttactctgtttatggcaacaactttatcttttaaatctaattcttcaggattaaaatttttattcattcttccctttagcctccttaaaattcaagtccagcttctcttgcaccttcagctagagcttttactctaccttcatatacatatccgcctctatcgaaaacgcattcgctaatgttattttctttagcatttttagcgatttctttaccaaccaatgttgcactttcaagttttggtaacttagcgcattcttctttgattgtagcatctaagcttgaagcagctgcaagagttactccgtttacatcgtcaataagctgagcataaatttgcttattgcttctaaaaacatttagtcttggtctttcaggagtgccgctaatcttatttcttactctaagatgtcttttctttctgatttcatttttattaacttttgatatcatctattcgccctcctatttacctgattttccttctttaattcttactctttcgtcagcatatctaacacctttacctttgtatggttcaggacttcttttagctctgatattagcagcatgtgcgccaacgaattgtttatcaatacctttaacgataactgtgttttgtccttcaacaacagtttcgatgccttctggatcttccatttctactggatgagaatatccaaggctaagtactaatgttttaccttgtttttgtgctctgtaaccaacaccaacaatttcaagtttcttttcaaaaccattagtaacaccaattaccatgttttgaattaaagctcttgataaaccatgaagtgaacgatgtcttttgtcgtcactaggtctttttacttctaaaacattatcattaatttcaataatgatatctttatctatagcttgtgttaattcaccttttgggccttttactgtaactacgttattttcgtcaacttttacatcaactccagctggtaaattaacaggtgcatttcctactctagacataatctatttcttcctcctattttttctaccatacgtagcatattacttcgccgccaacgttattttttctagctaatttatctgtcataacgccttttgaagttgatataattgctacccctaaaccatttaaaacttttggtaaatcttcatttgaagcataaattctaagacctggtttagaaattctctttaagcctgcaattactttttcaccgttttgaccgtatttcaaagtaattttaagcatgccttgtttattatcttctataaaatctactttctttatataaccttcttctaataaaatgtttgcgatagcttttttaatattagaagctggaaccattacatctttgtgtcctgcgttatttgcgtttctaattctagttagcatatccgcaattggatctgtcatagacatattagaaaacctccttaattactttctttaaaattatttctaccaacttgctttctttacgccagggatttcacctttgtaagcaagttctctaaaacatattctacaaataccatattttcttaggtaagcatgaggtcttccgcatattttacatcttgtatatgctcttgttgaatactttggtgttcttttttgcttttctaccattgcttttttagccatatcttatcctcctatgcttctttgaaaggcatacccattaatttaagtaattcatagccttcttcatctgtatttgctgaagaaacgaatgcgatatccattcctcttaatttttcaattttatcataatcaatttcagggaagataagttgttctttaatacctaaagaataatttcctcttccgtcaaaactctttggatttacacctctgaagtctctgattcttggaatagcaacatttagaagtctatcagcgaattcatacattctttcacctctaagtgttactttcgcaccgattgtcataccttctcttaatttgaagtttgatactgatttttttgctttgatcataactggtttttgtccagaaattaaagcaagttcgtttgcagctgcttccatttgtttagagttgtctttacaatccccaaatctcatgttaataacgattttttcaagtcttggtacttgcattacgtttgtatagccgaacttttcagtaagtgcatttataacttcagctttgtatttttctcttaatctactcattaattactgccccctactatttaaaagttgcattgcattttttgcagtatctttcttttttgccgtcgttaacttttacacctgttctaacaccttttttgcaagtgtcacagtataataaaacgtttgaagcatcaataggacatgcttcttcgacaatacctgcttgttgcatttgatttgttgcttttaaatgtttttttcttacatttacattttcaactattactctgttttcttttggaaagctttttataactttgccaatagttcctttatctttaccagaaataacaattactttatcatctttctttacatgcattataaaagcctccttatagtacttccggagctagtgaaacgattttcataaatttcttacttcttagttctctagcaacaggtccgaaaatacgtgttcctcttggttgattatcttcttttaatataacagcagcgttttgatcaaatttgatataagtaccgtctggtcttctaacaccgcttacagttctaacgataacagcttttacaacatcacctttttttaccattccgcctggagcagcacttttaacacttgctacgataacatcaccgatgttagcagttttctttttgcttcctccaagaactctgatacataatagttcttttgcaccactgttatcagctacttttaatctactttcttgttgtatcattctttaaacctccttaaaacgccgaaaggctatttaaccttttctacgatttcaactaatctatgacgttttgatttgctaagtggtcttgtttccataattttaacaatatctccaacatcacacatgttttgttcatcatgagccataaacttagttgttttctttacacgctttttatataatggatggtttaccattgtttcaatagcaacaacgatgcttttatcacctttgtttgaaacaaccttaccaattcttacttttctatttcctctttccatattatcctacctaaaaattactaagcgttagcttgtaattccctttctctaagcacagttttcactctagcgtagtctttcttaacttccttaatttttaaaggattatcaagttgtcctgttgcatgttgaaaacgtagattgaataattcttcttttaaagagataagttgattatttaattcttgttcactcatatttctaatatcttgcgctttcattatgcttcaccacctactaatttttcttgttctgctctagtgataaattttgtcttgattggtagtttatgttgagcaagtctcatagcttctcttgctgtttcttcatttacaccagcaagttcaaacataactctacctggttttacaaccgctacccaatattctggagcacctttacctttacccatacgagtttcggctggtttctttgttacagacttatctgggaaaattttaatccaaacttgtccgcctcttttgatatatcttgtcatggcgatacgggctgcttcaatttgatttgaagtaatccaagctggttctaatgcttgaatagcgtattcaccgtaagttattttattacctctcgtagcttttcctttcattctgccacgatgtacttttctatgttttactcttttaggcattaacataactgttatttatcctccttaattgaaatactgattattcacctttagttggaagaacttcgcctttgtttatccaaacttttacaccgagtttaccgtatgttgtatctgcttccgcaaaaccatagtcgatgtcggctcttaatgtttgaagtggcacgtttccatcactatattgttcagttctagccatttcagcaccgtttaatcttcctgaaacgcttgttttaataccttcagcgccacctcttaaggctctgccgatagcttgtttcatagctcttctgaaagaaattcttctttcaagttgtgctgctatgttttcagcaactaattgagcgtcacagtcaacattttttacttcgataatgttgatataaacatttttgcctgtcattttttgaagttgttttcttacagcttcaatacctgaaccggctttaccaataatctttccaggtttacctgtatagataaagattttaattttttcaccgaatctttcgatttcgattcttgaaatacctgtattgtattgtgttgttttaatatattttctaatattgtaatcttctactaataagtctccaaagtctttatctttagcataccatcttgaagaccaatctttgattacgccaactcttaaaccatgtggatttactttttgacccatttagattttctcctccttatgctctttctttaagaactacactaatgtgtgagcttctttttaatatcatagacgctctaccttgagaaccagctctaaatctttttagtgtaggtccttgattagcactaatttcagagatatatagctttgtaacgtccatatcatgattattttcagcatttgctgctgctgattttactactttttcgatttctcttgcaggtttgttacctgtaagttttaaaatattaatagcttcgcctaaatctttacctcttactaaagaagcaactctttttaccttaataggtgaaactcttaaatattttgcagttgcttttgcttccatttacttttcctcctattaagccttattttttaactccagttttcttttcgcctgcatggcctctgaatgttcttgttggtgcaaattcaccaaatttatgtcctaccatatcttcaacaacaaagattggaacatgttttctaccgtcatgaactgctacggtatgtcctaccatttgagggaagattgtacaatcacgagaccaagtttttactacttgtttatcgccgctttcattcattgcttctattctttttagaagtctttcatccacgtaagggccttttttagttgatctactcatctcctacctcctatttaccgtttcttcttcttacaatgtatttatcagaatgtttatttttcttacgagttttataaccaagtgttggtttaccccaaggagtaacaggaccacttctaccgattggagctttaccttccccaccaccgtgtggatggtcgttagggttcataacagaacctcttactgttggtctaatacccatatgtctttttctaccagctttaccgatagtaataatttcatgttcaagatttcctacttgaccgattgtagctctgcattcttttcttacaagtctcatttcgccagaaggaagtcttaatgttgcatagttaccttctttagccattaattgaacataagttccggcacttcttgccatttgagcaccttttcctgctttaagttcaatattgtgaagaattgtaccaacaggaatatcttcaagatttaatgcattacctactttaatatcagcatctttacctgacattactgtatcgccaacttttaagttgttaggagcgataatatatcttttttcgccgtcagcgtagaataataatgcaatgtttgcacttctgtttggatcgtattcgatagcatttacttttgctggaataccatctttatttcttttaaaatcaatgattctatatttttgtttagcaccgccaccatgatgtctaacagtgattctaccgttgttgtttcttccggcagtttttgttttcttagaaacaagtctcttttctggagaagtctttgtgatttcttcaaaagtagaaactgtcatacctctaagacctggtgaggttggtttatattttttaatacccatcagtaatagcctccttagatattttcaaagaacttaatttctttactagcttctgttaaagtaacaatagcttttttccaattagctcttctaccttgtgttctacccattcttttaacttttccgttcatgttcataacattaacttgtttaacatcaacatcgaaaattgcttctacagcatctttaatttgatacttgtttgcatttttcataactttgaatgtgtattttttgtttgctgcatcaatcatactttgttctgtaacgattggtttaataataatatcatgaggattcattatttatatacctcctctattttgtttaatgcatctttagttaaaactaaattgttgtattttaacatttcatatgcgtttaatgttccaactgttgaacatttagcatctttaatgtttcttactgaattaacaacatttacgtcattttcatcaataacaactaaagttttgtcaatgtttaagtttttgaacatatcaacaactactttagtttttggagcttcaagcttaagttcatcaatgatgaataattctttatcgcttgctttagctgagaatacagatttcatagctaatcttctcatttttttgttaatgctttgagaataatctcttggttttggagcaaatgctaccccaccaccagtccaaactgggtttcttgaagaaccaactctagctctacctgtacctttttgtctccatggttttcttccgcctccacgcacttctgctcttgttttagcgctttgagtaccttgtctttgattagcaaggtaagctttaacatattgatgaacaactggcatgttaggctctatttcaaaaatttcagcgtttaagtcaacgcttccaactacttcgccttttatgtttaatacatctgctttcatttctatcctccttacctagtactctctatttagaagccttgatactatcagtaattgttacgatagaaccattagaccctggaacagcacctttaacaaggagcatgttattttcactatcagctttaacaacagttaagttttgaactgttactttttcgctacccatatgtccggccattttcttacccttcataactctaccagggaaagaagctccacccatagcaccaactactctatgagatttactaccgtgccccataggacctcttgattgaccgtgtcttttgatagcaccttggtatcctttacctttgctgatacctgtaatatcaattttatctccggcttcaaatacatcagctttgatttcatttccaacttcataacctgaacaatcttcaaatctgaattcttggatttttcttacaggtttaacacctgctttttcaaagtgacctttcaaaggtttgtttacatttttttcgttaatttcaccgtaaccaagttgtacagcttcataaccgtccttttcgattgttttaacttgtaatacacagcaaggaccagcttgtaatacagttactggaataactcttccgtcttctgcaaaaacttgagtcattccgacttttttagccataatagcttttttcatgtttttacctccattagcggactactttttggtagtcataattttataacttgatttcaatatcaacaccagctggtaagtctaatttcattaaagcttcaacagtttttggtgttgggttaaggatgtctacaactctcttatgagttctcatttcaaattgttctctagaatccttatatttatgaaccgctctgatgattgtaactacttccttttgtgttggaagtggaataggaccagatacttccgctcctgttctttttgctgtgtcaacaattttagctgctgacttgtcaatcactgcgtgatcataggcttttagcttaattctgattttttgatttgccatactttcttcctcctaattatgattcgacagtacgaccatgcttgatacactgttccgtgtgtttcacttgtgagttagacgcacaaaaacaccaagcatgccgccccattctagatggtgacatactccacggaaaaacccgttcacacggcaacctcccgcttcaacgcattttcttctgtcatagcctactaataatacactataaaaccctataatgcaaggctttttttacatttttttttattttttttataaaaattttacgtaaaaaaattgtaacatttatcaataatttttaccatattttttattaataaacaaaaatttttttaaaaatttattttttttatttttttatgtataataaaatatgaaataaaataaaaatattatggagaaattacaatgaaatatttatttttagaatacccaaaatgttctacttgcaaaaaagcaaaaaaatggcttattgaaaatgatattgattttacatcaagacatataatcgaaaataaccctacaaaagaagaacttacagagtggattaaagaaagtaatctaccaataaaaagattttttaatacaagcggtatgaaatacagagaacttaacctaaaggataaattaaaggaaatgaatgaagatgaaatgatttctctcttgtccactgacggcatgcttgtaaaaagacctataataataggtaaagataaaatacttacaggatttaaagaaaaagaatgggaagaatatataaaataaaaaaagagtatgctccttttttttatttataaacttctgccatcatctttaccccaagtttatatccttttatatatgcatctctaagctctaaaggatataaacttatccatctttctataattttataaaattcattttgcatatcttcatccagcttttttataaaattctcttccgttttagtcatctctctaagttctaaagcatattcatccaaagcaattttcatctctgcataaggatttatattgccctcatataaatctttcaatatactactcataccaatccctcatttttatcaatattatttttttatcataaaataatatgaataaaattttattctgattttattatatacacgaaaaacatttagacaataatatgaagcaaacaggtcacattttagtcacaaaagttacatttgtcttaaaaaagtaaaatttaatattttgaataacattataagtttatttctgttataataaaaatgcagatttataaaacaggagtgaaacaatgagcaaaatttggggacatttttataccatcacaagacacaaaattatagttttaaaaacctgttttaaagcaggattatataaacaaggtttgcttcatgacctttcaaaatacagctttatagaatttggacgaggcgtaaaatactaccaaggaggcaaaagaagcccaataaacaaagaaaaagaagttaatggatatgctcttggctggcttcaccataaaggaagaaatagacatcattttgaatattggatagattataaacctaatcctcacgaaggattaatgggcgtaaaaatgcctaaaagatatgttgcagaaatggtaattgatagaataagcgcttcaaaaaattatttaaacggaaattacaaagaagacgaacctttaaaatactggctaaaaggaaaagacttctatattattgacgaagacagcaagaaacttacagaatatcttcttattatgttaagagataaaggtgaaaaagaacttctacattttataaaacatacattaatgaaagaaaaaaataaagattataagtttgacggagataaattagtattataaaaaaagagaatattaatattctcttttttattcccatttatcttttattgatttactaacctttccctcaggcatacctctttttattatatccttaccataactctctctaagtttatccataactttctccacttttcccattttatcattttcagcattattttcaattaatgacagttgagatactgtattttcacttactccggatatactaacaccaagcagtcttacactgtttccgttccataattcatcaaacaataataaagcctgcttataaattgtatcagtggagctggtataaaatgacaaggtctttctatgtgaaaatactttaaaattactatattttattgtaacaacaataacatttccttttacatttttctctctaagccttgaacctatgctatcgcataaagcaagaataatttttcttatttttaaaatatcagaagtatcttcacttaaggttgtactatttccaacagattttatttttctttcaacttctactttagaatcatctatgccatgagaataattataaagcattatcccctgtgaatttttaaagtgagtaataagatactgcagggaacaattactaagttcaccaattgtatttattccaagcttattaagtttttcttttgtttttttaccaaccataaaaagattatctataccaaggggatataatttttcttccagctcatctgggaaaagagttattactttatcgggcttttctaaatcccctgccatctttgcaagaagtttattacaggaaactcccacgttcacactaaatccaagctctttttttattctttcttttattttatatgcaacttcaacaggctgaccaaatagctttatgctctcgctcatatccaagaatccttcatcaatggaaaacctctctattttatcactatacattgaaagaagttcaaacattttttttgaatacatcctataaattttaaagtcaggtttagctattacaagattaggacaaagcctctttgcttcaaataaacttattcccgtttttataccataccttttcgcctcttctgattttgcaagaacaacaccttttcttgcttcttcatcgccacctatcacagaagcaactttccttaaatccaaaaagtccggattgatttttttattatacgcacagtgccatgataaaaacgcagaattaacatcaatgtgaaatataattttctccatttttcttactcacctttcttataataaaaatataccacacaaacgggaataaaacaaacatttgttcatagatgaaaatattttgttagttttcactaataacaatgctctttcccattgacttaaatattatattgaatgtataatcaaaaacggaacaaacgacataaaaaagaagggataaaaaatgactttagacaaacttgaaattggtcaaaaagcagtaataaaaagtacaggcggagaacctgccataagaagaagacttttagatataggactaatacctaaaacagtggtatttatcagaaaagtagcccctcttggagatccgatagaaataaatctaagaggttttgaacttactttaagaaaagaagacgcaaaaaaaattgaagtagaggtgctttaatatgaaaagaacctttgcacttgtaggtaatcaaaactgtggtaaaacgacattatttaatgcccttacgggaagtaatgctcatgttgggaatttcccaggtgttacagtagacaaaaaagaaggtccaataaaaggacatgaaaacataaaccttgtagacctgccgggtatatattcactttcaccttatacaagtgaagaaatagttacaagagactttctaatggaagaaaaacctgatttaataataaacatcatagatgcttccaatatagaaagaaatttatatcttacacttcaactacttgaattaaatattccaatggttattgcacttagcatgatggatgaagtgatagcatgcggaaatagtatagatattgatacaatctcaaaaagattaaatgtagaatgtattcctatacaagccgcaaagaatcaaggaacagaagaacttattgccgttgcaacggacttacttgaagaaaatgcgtatagaggcaaaattgatttttgtagcggatatattcataaagcaatacattcaatatctcatataatagaagcaaatgcagaagaaaaaaatcttcctgtaagattttgtgtttcaaaaatagttgaaggtgattccttaatggaagataaacttgaacttagcgatgcggacaaagatataataatgcacattgtagacgaaatggaaaaagatgtaggtcttgacagagccgctgcaattgcagaaatgagatatgattttatagaaaacctatgcaaagacactgtacataaagtctctcatacaaaagaacatattaaaagcgtaaaaatagataatttccttacaaacaaatactttgcaatacctatttttatacttattatgggagcaatattttatctaacctttggagttatcggcgcatttttaagcgatgcatttgaacttttacttgaacacataaaagtttttttaaacggaggacttacaacacttcaaataaacccaacacttcgttcattaataatagacggagcatataacggaatatcatctgtattatcgttcttacctatcattgtaacgttattcttcttcttatcattactagaagacagcggatatatggcaagaatagcatttatcatggacaaacctttaagaaaaataggtttaagcggtaaaagctttgttcctatgctaataggttttggatgttctgttccgggaattatggcaacaagaactcttacaagttcaagagacagaaaaatgacggtgcttttaacaccttttatgtcatgcagtgcaaaacttcctatatatactgtatttgcggcagcattttttggagataatcttcctcttgtaatgatttgtttttatctgcttggaatattaacagctgtattttcaggatttttattaaaaaatacaatttacaaaggagaatcaatgccttttgtaatggaacttcctccatacagacttccatcaatcaaatctcttacaagacttagttatgaaaaagcaaaagattttgtaacaagagcatttactataatatttgttgccagtgtacttatatgggtacttgaaaactttgattttagatttaatatggtggacaacccatcttcaagcatacttgcttcaataggaaactatcttgcaataatttttaaacctttaggttttggagattggaaattcgtaacttcacttattgcaggatttagtgcaaaagaggtcgttgtaagtacacttgcagtacttacgggaagtacactaaatacattacctcaaattttaagcacaatgctctctcttcctgctgcaatatcatttttaacatttacgcttctttatatgccttgcgcagcagcttttgcagcagcaaaaagagaaataggttcatttaaaggtgctgttttaactgctatgtaccaaacaggaatagcttatgtaattgctttaatagtttataatatagcaaaacttactttataaaaaaacaagcaatatgcttgttttttatttataaagaaactaaagaacaagtatattatgtttattgttaaaaaaaaaatattatgatataatttattatcagtaaatttttaatccccaaacagaggtttaacatgaaacttaaaataaattcaaaaagaaaaattgcattaataatattaatatttttatttatagctggatgctttacgcaattatactcaacaaatacatattataaaatggataaagtagaattttacaacttagatgaagaagaaatatccgcaagatattataaaggttctaccaacatgggtgtatttatagcaaatgatttaagcgccaacgcaaaagacacatggtttatggttgaagaatttgcaaagcttggttacagcgtttatgtttttgattatccaagtcaaggacattctgatggacacatcgaatttggatataaacaaaatgaatacttggcagaacaatattattcggctattgtagcattttcgcaaatggcaaaactaaatgaagaaaacatacatattgttgccgtaggtgaaagtgcaagaacagctcttcaaacagcaactaaaagatttttcaaccctaaagatctaacattaatttcaactaaaacaaatatacttggaaaaatcgatttagatgtaattaactttgtaaaagaagaaaatgttacgttcatgaaagaacttaatgcttcaaaccccggagaaaatattcacttaataacatcaaacttaaatgatcaatcaagtgttaaagaaaacgaagctttaaaaacaagactagaacaaggaaaaacaggaagtccagaagaaaatgaagtaactctaacagttacacaaaatgttttaccaacaaatgaaattacaagcagcaaaataataaaagaaacagtaagttatatagctcaaagagatgggtatgaatataccccaagtaaattcttaacattaaaaacaatgttacctgctgtactttgcataattgctttctttataatattcctttcctataaaatagttgaaaaagattattataaagaaaaaggaacaataccttttaacaaggaatttgtaatatcaaaacttttggcagtaataccatccttaattatggtattcctacttccggtagcactatactttttattaagtccgattatgtcaattccgtattacactttagttaaattatcattgttatcatgctacggaatgataatattctatctttactatagaacaaattttgcctgcgatataggaagtcagatattttataaagatcctaaaaagaatgttaaaggcggtttaattgttgctattggtataattgcaatactataccttctttcggtagcaggatgcaatgttgttttcaacattacatcaataaaagtattttggctaatactttcaacaatactatgttattttatattctacatagaagaaagagaaaaagaagttatgattgcaacacaaatgcaaagatttataatatcatgttttaacttccttattattcctattgttgccatagtaatgttaataatgggtcaattttcgattgcaataagttttatgggacttgttttcctacttgtgtttgtacttgcagttggaaaactattaaaagccgttgattcaccaacgagactaaacgcatttatacaagctttaatattaaatgcattaatacttgcacaaacagttttattcttctaaaacaaaaagcctctttatagaggcttttttatttcatatttttttattctaatattttttttaaatctttaataaattgtttctgttgtttctttaaatataattttacaaaaggcttcataatttttttctttactgttatatgttctgaaaaatcaacctgagtcttatcttcttttgacgtaaaaacgccaatccaatgaccttttatattgctgttttccatatcaaattcccatcttttataaggctgtaataaagtaactgtaaaaattgtataataaccttttttcgtatattcaacaaattgattttgactaacaatttttgttttacttaggtcacttcgccatgtattatatttactaacatttaaagtcatttcccaaactttatgtatatcactatctataacatcttttatattaacagttatcatttttatacatcctctcataacttaaactttcatatactcataaaatactacattataattgtatcaatttacatatttttctatatattatttaaaatattttatacttattatagtgttatattttttatcttcaaaaccatatttattaatatattttatttttataaaaaaagagtaatttaaaattactcttttacattaaataaacttctgtttaaatataaataatttactcctgaaactacagttaaaattaatgctatatacataaggcctaaagaaatattaaaaataatattacttaaagctgaaaaatgcattaataccaatgctatcatttgagtagtcgtttttaacttacctattttatcagctgctataacaactcccgcagatgcagcaagaactctaagcccagttacaataaactctcttgcaagaattacaattacaacccatgaaggaataaagtttatttcaacgaagcaaagcatcgctgccattacaagaagtttatctgcaagagggtcaacaaattttccaaaatctgtaaccatattacatcttcttgcaatctgaccatcaacaaaatctgatattgaagcaatgataaatatcgctccagcaatcatataattattttgtatacctgtaagcatcataaaaacaacatatacaggtatcataaaaactctgaataacgtaattttatttgctaaattcattatatcgtccttcctattaaatcatattccattgaatcttctattaatatatcataaaacccacctatttctaaaggtttatgggcataaatataaacttctccgtcaatttcaggacaatccatatagcttcttcctatataaacattatcttctccctctacttcttcttcaacaagaacctctaatgtcttatctagatacatttccataagctcttcagaaacttcttcctgagcttgcataagttcaatatatctttcttctttaatttcttcatcaatttggttatccatattgtaagcaggcgttccctcttctctggaatatttaaagaaccctaccctgtcaagttgatataattttataaattctaaaagttcttcatgctgctcttttgtttctgatgggaaacctgtaatgaatgtagaacggatttttattccttcaacattctttcttaatttccttataatagaaagtatatcttcttttgaagttcttcttcccattttctttaatatatcgttattaatatgttgaagaggcatatctatatattttacaactttatcaagttttgcaagtttatcgataagctcatctgaaatagtttcaggataaatatataaaactcttatccactttaagccctcaatattatttaattcctcaagcaaatcaggaagtcttctcttaccatataaatcagtaccatattctccaacgtcttgagctattaagattatttctttaactcctctttgggcaagtctttttgcctcagatactatatcttcaagctttctgcttctttgttttcctctgatacttggaatgacacaatatgtacaatgtttatcacatccttcacttacctttaaataagccgtatatgaaggtgtagacaatattctgtctgtttcaacaataggacaatttatattttcaacattaactaaagtactttcactatctttatcaagtttttcaagaacttttgccatatcataaaattcacctgttccaacaaaagcatcaacttcaggtatttcctttaataactcttcatgatatctttgagcaagacatccagtaactattatttttacttcatttctgtctttttttaccaaagtagcttcaagtatcgaattaatgctttcttccattgcatcatgaataaaagtacaagtattgattattatataatcgcttattgttgcatcatcaacaatctcatacccttgctcttttaataaatacattatattttcactgtctacggtattctttggacatcccaaagttaaaataaatacttttttcatatctatctccattacattatttcatcttctatatccagtgttccctcaggataaacttcatcactttctacaacactattggagaagaaatcctctctcttttttaaaacttttcttggtttacttccatctttaggagaaatgattcccctttgttccaattcatcaataatacttccagcccttgcataacctattctaagtcttctttgaagcattgacgttgaaacttccccaagttcaaatgctaagttaagtgcatcattaaacttttcgtcaatgaaatcttctttgtgaagattttccttacttcccggcatattttcttcagcggaaactgtttcaataccttttattgcatcttcatcataatttggtctttgtgtttccttaatgaattttacaaccgactcaacttcttcatcactaataaaagcgcactgtgcacgcataggagcattacttcccacaggagaatataacatatcccctcttcctaaaagtttttctgctcctgccatatcgagaatcgttcttgaatcaatttgcgatgatacggcaaaggatatacgagaaggtatatttgctttaataagccccgtaataacatcaacagatggacgctgagttgctaaaaccaaatgtatacctgcagctcttgcaagctgagcaagtctacatattgccgattcaacttgagaagcacaagtcatcattaaatccgcaagctcgtctataatgataacccactgtgccattttttctccaccggtcttttccattttcttattatatccgtttatgtctcttactctgttttgagcaaataaatcgtatcttattttcatttgcttttcagcccacttaagagctcctgccgcatgatttgggtctgtctctactggtacaagcaaatgaggaatgccttcgtatatattaagctcaaccattttaggatctattaaaataagccttacttcgtttggatctgcgtggaataaaatagaatttattattgcgttaatgcaaacactttttcctgaacctgtggcaccggcaattaataaatgcggaagtttggctatatccattataaccatatctcccgtaacatttttaccaagggcaacagataatttagattttgcatttttgaatttttcatcttctacaatttctctaaatcctacaacagatacttctttattaggaacttctatacctattgcacttttccctggaataggagcttccattctaattccatttgctgcaagagccattgccaagttatcttgaagccctacaaccttacttacttttatacccggctcaagttccatttcatatcttgtaactgtaggtcctatactaacttcagttactcttgccccaactttaaagtttgcaagagtttcttcaagtattcttgtgttttctaaaaccctgtctctctcccctttattatttctatttttatttggttttaaaagagatgaatcagggaatacataaggtatctgatctttttctgtaactaaaggttctttatcttctatttccgtaatttttgcaatacttccgttatccattgcaactcttaatttatcaagttgctctctttgagctttattggctctgtctatatcacttatatcaattctttcaataggtatttcttccccatcttcaataaaatcttctttatttataggtttatgatttacaaagtcttttgttctttcaatttgtttatttgtttcatcttgcttttcctgagtttcttttattatctcatcaaagccttgttcttctcttactttgttttttatctcttctttacttagtttttcattttgaataacttcttcttttggcttttcttcgttaacttcttttttaaagtctccattttcatttctataataagtccttattataggttcttctttctttacttcttgttttacattctcactattatcttttttcttaaatggatttttgcttttcttatattcatcttcccatttatttaaaacttcttctttatccttacttgtttttattgcatctttttcatcatatggattttttataagtttacttttaaaagaaggaaagaaagatgttcgtacaggttgtctatctgcttttgttcttaactgctcttctctgtcttgtattttctttgtcaatctttgagcttttatctctttttttacttctctttctttttgtcttattgcttttctatcttctttataacttgcaatattgtctttgaatattaatattaaacaaactataatgcaggcaaaaataaatatatatgcacctgtttcaccaaggaaagtcgtatataaacctccgagccatatacctattatgccgccttttgttacaacatttagcacagcattaaaaagctgatttgtaaaagcaccatattttaaaaggtctcctccaacattaaaaaatgccattatgttaaatataataaaaacaatacaagctaaagtaagtgtttcactaaaaggttttaatttagatgttatataaacaccaagacctaaaaatgatactcctattaaaaaagctcctacactaccaaatagaaacatagaaatattatgcaaattatttccaaaaacaccactgtcttttgaccatatagaataaagcataaaaacaccaaaaaagaaaataataacacctattatttcattttgaattattttctttttaaacatttcttgttcaagctgcttttttgtagttcttcttgatgatgtttgagttcttttccttgccgttgttttctttcttgccaagttcatacctcacatatgtaaatttaatattattctttatttatgtatcagtatattttatcatattttcattttaattcataggataatatatcttataatttataaataaaatataataaattgtaataaaatataaaatttatattttatgaattaattaagttgcattttaatattaatacattttcatttccatatgtatttttaaattaataataatttatcaaaattttttttaatccagttaaaacaaatcctttttttattttgtcatattaagaaaataacacaatataaatatattataacatttattggaggaagcaatggcttattcggacagagaacttttagcaagattaattgagtgcgaagcgggaggcgaaggtaatgaaggtatggccgcagtagcaagtgtagtcatgaacagagtttatactccatatggagaatattcaagagtttcaaacggaggaagtatcagaaacataatatatcaaaaaggacaatttacctgtgccatggaaactgtaaacggagaatataacccacaaaacatatacaatatgaatcctacaaatattcattatcaaatagcagactgggcaatatcgggaggacggctttataatcttggatacgcactttggttttataacccttttcaaaataactgtagagatttttttccaagcgaagttggaagtttaataaccaaaataggaaaacattgcttttataatccaactgaaaaatatttacaaacttaaaagagaggtagatatggatagagaagataatttaaatggaatcttcagtggtcaaaactataataagcaccttgataatcaaatggataataattttgaaccggaaaaagacagtgacggttccaatgtcccttctgtatttacagtaggtactactcctgatatactaaacagaattaaaggtgaatactgcgtatgtgaatttgtaataggaagtgatacattaataacaaaatccggaataatgtataatgttggacttagctattttactctttttaatatttctaataatgaatatatagtttgcgatatatattcggttaaatttataacggttcccagaacagatgtaatatctcaaagaaacatatcatcaaatcaaagaagaaatagaagataactcttttgtataaagaattttaaatttttattacataattcctataaaaatggtataatatgtttatggcaaacagcttaatcgtagacatcatgactgctattaggctgttttattataacattttataaaaaaggggttgttgtaatgtttagtttaaatgaaataattcaatatgataacgaaggactatgcaaaatcagtgaaattgtagaaaaagactttgcaggggctaaagcaaaattttacgttctaactcctattaataaagatagccttacaatatttgttccaattaacaataaaaaacaaacacaaaaaatgagaaagattttaactccaaaggaaatctataatttaataaatgacataaaagatgatgatttaatatggattaatgacgacaacgaaaggaaacaaacatacaaacaaattatacattcaggagacagaaaaaatataatcaagttaataagaacattatatttacataaaaaagaacaaataaagaatggaaaaaaactgcatatgtgcgatgaagagatattaaaaaatgcaacaagacttctacatgaagagttttctcatgtattaaatatagagccggaagaagttgctccttttatatcagagcatattaaagttaaagaaaaaataaacgtataattatttttcccgggaaataaagaaccgatttacttgaagtaaatcggttctttttacattgaatttaaaatattatcaagctcattcatatatttattatatgctttgctatctccttttgcctgtgcatctttcattttattcattagatctcttgctttatcctcaagagagaattcagtatcttcctgcctaccttctttcaaattaaatatagcatttattccttcacttaaagaatcttccattacgatttgttctccataagcaactataactttttttacttcaggcagtgccatctgatctgtttttgatttaacatatattggctcaacataaagtatactgtcttctataggtatagtaagcatattacctcttgaaacctcgctgcttgcctgtgaaagcaagtttaatttaggagcaatgttcgtatcctgatcaattctttgctctatctgcatcggtccataaacaagtttttgtttcgggaatgtatatactttcaatttaccataatcttcaccatcacatatacctgccatccatgcaaccatattatttttgttatttggcgtaaaaggtgccataatcataaactcctctttgtcactgtcaggaagtttcatcatcatataagcactgtttacatttacagcttcttttgctgttccataaaattgttttgcagtctgccattgatcttctttgttataaaaaacctgtggatttgtcatatgataagtttcatacatactgctttgaatgttaaacaaaacttctgaatatctcaaatgctcttttaatatcggatccatttcttcaagtggtttaataaatccaggatacattttagagtaaagagttgctataggatcgtttttatctacctgataaaattcaactgttccgttatatgcatcaacaacaactttaacagagtttcttatataattgaagttttgcccatcttgaaatttagaaggtgttgaacaaggatatttgctgcttaaagtaaaagcatctattatccaatataatctgccatttgcatttacaatataaggatcttcatcatattccaaaaatggagctataatacttactctttcttttatttctcttctaataagaaccttactatcagaggttatatctgatgagaatataaatctgctattcatattatttattgaaaaagcaattctatttaagaaatttaattgtatccctccacttccgccatatctgttttcaacattattatcaccttcaggataatcaaattcgtcacttttacaatttacaatggcataatcagtagtcatttctccataatatattctaggttcggttatttttaaatcatcatatatagtagttgcaggtatatccttttgaatcaaaacgggctgacctgatgaatttatttggttaacaggagcaactacacttccatagccatgagtatatttttgatgtttatttacaaaacttcttacattttctttactgcttggttgcatttctcttacagaaataaatacttgtgtgggatctccatcaagattatatctgtcaacatcaacatctttaaaagaataataagacctaaacccttgaagagaattaaaagtatcaagggcaggaaggaaatcatttataggaatattacttattgttacagagttattttcaatgtcttcttttgttaagttgttatctgctttaaaatctttaacctctacgtctgcaatattgtatgcatctcttgtcatatcaatattattattaatgtatttttcctctttagcatattcatttggaactactatataattttgtattacaaactttaagccgactaaaccaaatacaaataaaggaactattataatgcatataataacaggtttaactttatttttaaaacagcatatccaaagaataacagcaaatataatcataaatacacttaatattttatatttgttaacatcaattaacatatctgcataagtagatccgtagacaatccccgaagaatcatagcatacattaaaaatattaagataaaaatgaatacttaaacataaactattttttgcttgttgaaaaagccactttgtatattcttgtgaaaagggtaatttttttgcaagtttaccgtgagtatgtatatctaaattcattttttctccttataaaataattagctttgaaaataaaatacaaacgaatatccataaaacagaaattataataaaattaatgtccattttagttatgcataatgaagatagttttaatttctttacattttcattattcatagagtatctataaccttttatttctaaagcttcaactgttgttcttgatttttttgccatattaagcattaatgggtaaaatgataaaataattatttttatttgataaattaaatattttatttttccaattagagtgttgttttgaggtgggtttcctctaagtttataagatagaagaatattttgaaattcttccataagtataggtaaaattctatatccaaaagaaatactaaaagaaagagtttccggaaatttaaaccataaaagtccatttgcaagcctatctggatctaagcccgaaaaaactgttattgaagcaagggaaacgattgctatttttaatgtcattattaataatgggataatcgttgttgtatttccaccaaaaaataaagcaacaaaaaataaatatcctgtttgagaaaatacaccaaggcaaaataaaaataaaactaaaggtgcgattttagctaattttgttgttatgacaaccaaaataaaaatgccaagcagaataattatattgtttaaaaaccaaggtactattccaaagaaacaataccaacataataaaactcttggatctagtttcgctatttttgtatcatcgtttccatatgcgttttttagaacttgatttcttatataatcaatagatattttatctaaaatattttctgatagtttgtttttcatttatgcattacctccaaaagcattgcaaaattcatttattgtataacaattggattgtttgtcaagcatttttgccatagaatatatttgtggcggatttattcccataatatctgttacaatgttattggaaaatactttatctttattgccgtcatctataatttgtccacttgataacacaattattctatctgcccagtcacatacaagttgcatatcgtgtgtggcaataataacagtatgagtgatatctttaatatcatttaatgttttcattatttctttccttgtagcaatatctaaatttgctgtaggttcgtcgagcaataaaattgaagggtttaacgctattcctattgccagtgaagctcttcgcatttgtccacctgatagcattctgccatctttgtcttttatttcatttaaattaaatcttttaagtagttcaatggttttttgtttataattatcaatatttcttgatttaagagcaaagcttatatcttcctctattgaatctttaataaacatttgttcagggttttggtataccagtgaaattttttttgataagtctttataagggatatcttttatattttctccatctattaaaatatttccattatcttgttttataagccccattataagcttcattatcgttgattttccagctccattagagccaattaaagcaactttttcatcttttttaatgtttaaattcatatatttcattatattgtttcttttaccttttacagctctatatgatacatctatatttataaacgagataacatcttttttttctttgatttcatgaaaattatttttattattaaatttatatttgtaatttttaaagaaatctaaaccttcctctaatgttgttggaagtttttttgtattattttttattatattgttatcaattaatttttttgctgcaatggtgatttgtggagggaagatgttattatcttgtagcttatatacatctcttagtgcttctttagcattttttttccataagatttccccgtctttcatcaaaattgcatttttacaatattgtgcaataaattctgtatggtgttctattacaattattgtcttattatatttttcatttagcatttttaatgtatcatatattttctttgcattttgagggtcaagctgagcaattggctcatctaagattaaaatatttggactaagagaaattgttccagccaaggcaagaagatgtttctgccctcctgaaagttgccaaatataatcattcatatttttttcaagaccacataactttactgcttttttacctttttcttcataatcttcatatgcataatttaaacatgcatatgatgcttcatctaaaacagttggtctaactatttgattttcaaagtcttgatatacatatcctactttacatgcaagttgtccgatatctgcctcttttgtatttgttttatctataaaaatatctcctgttatatcaccatcgataaagtgaggtattaatccatttaatgttttacaaaaagttgatttcccgcaaccattgttaccaatgattgcaaggaaatcaccatcttcaatatttagattaatattttttaatgtaggtgtttttgcagcaggatatgtaaatgttaaatttttaatttctatcatatcctttatttaacctctgtatttttctttttcttcattgcgaaaagagtaataattgaaataataaaagcaacgattattcctataaatattgaatttgtatttcctgcccattcagcttcccattcaattaatgccatgccgttttctgcaagaaattcactgataattgcaagaataaagaatcctatagatgataaaataatttttggagaaatgccttcaaaagaagtttgaggatttctaggtctcattccaagaagaggttctatttttccataaagtttaggagctaggaaaattgtaggtaacatacaaaatagtattcctgagaatagaacgtcatttaaaaatgcaaatccttctgtaaagaagacactttctggaagccctgcaacagcttcaaactcttctattgcaaattgaacttttaaaatatcaatacaacatcccatgaattgttgtattattacacctgatattgcagctattgcaaccatttttttgtttttgggatcttttaccattcttcctgcaatataaatacctattgctagtgttataaatttttcaagttcacctattcctccaaattgtccaagcattatttcactaaaaacaatttctcctgttgctgcaccaagagcaactggtaaaggtgaaaaaagcattgccaatgttaatggaataaataagaaatattcaacagaaatttctattatacctatttgaaatgaaggtattagttctgtaaataaagtggcaatcccatataatgccattgataaaataaaaatcattaaattttgtgtttgtttgttcatttttttgttttcctccaaaatatataaatctaaaattattataaatattttatgtaaaataatctttcttttaacggtaaaaagaaagtaaattttcattatgtgttgatatgaaaaaaatatttcataatcctgtaaaaaaaaagcacataaaatgtgcttttttttattattataattattctgcaaaagtttcaagggcaagagttatcatatcgtttagttttgtttctctttctttacttgataagatagtatcggtataaataaaatgatcacttaccgtaaaaattccaagagcttttttatttaaggctgctgcaacactatataagcctgctgcttccatttccactccgagaattccaagctctttccatttcttccaaccgtcactgccttgtgcatagaagttgtcgcttgaaagaatatttcctacctttacatcaatattaagttcttttgctttattgtaagttttaataagcaaatcaaaatcagcaaggggagcgaaagttccgtctaagtggaactgagaagcaaagtttgaatttgtacttgcaccttgtgctattaatacatcgttaacttttacatcttcgctgtatcctccgcagcttcctattcttactatattttcaactccgtaaaaactatataattcatgagaataaattgatattgaaggtatacccattcctgaacccattacggagatgtttttacctttatattgtccactataacctagcattcctcttacatttgttacttctcttgcattttccaaaaagttttttgcaatatattttgctcttagaggatctcccggcattaaaaccgttttataaaagtcgccgtcttttgcgttaatatgaggtgttgtcattttttattcctcctaaattctgtaaacttcttttactccgttaatatttttaagttttctgaataaatcttctaactctttagtattatgaacatttaaacttatgtttacaacggagccatattttttgtctgatgaagcagagaagctagacatattaaatccttcgttacttattattgtcgaaatttcggcggacaaacctattctgtcatgggcagttattcttatatcggcttcaaaggttttgttttcctttaattcttccgtattccaagatacgtttataagtctttctttgttgattgaattacttacgtttatacaatccgctctgtgaatagatacccctctgtttttggttatatatcctactatattgtctcccggtacgggattgcagcaatttgagaaaaatacggcaagatctgtatacccttgaacattgattgcattgctgtttttgctttttttgttctttacaagtttaatttctttttctttttcttcgttttcaaattcatctttgaaatgttcttttattctttggaagaccattccgcttttaagtccgccgtatccaatagctgaatacaagtcatcccaagtatttacattaaaacgtttttttacgaattccaaatgaccgtttgtagcaattgtattaagagagtatccatcttttttaacttctttttcaagggcttcttttcctctaatgatgttttcttctctgtctgcctttttaaagaaagattttatttttgtttttgcgtgagaactttttacgatattaagccagtctctgcttggacctttagagtttggagaagttattatgtttactatatctccattttgaagtttatatgttaaaggtaccatttttccgtttacctttgctcctacacactgatttcctatatctgaatggattctgtatgcaaagtcaatagggcaggctccgcttgggagctgaataacctttgaatttggagtaaaaacgaaaacttcatctgtaaataagtcaaattttattccttccataaattcatcggagttttcgacttcattttccatttccattaattctcttatccaaatgagtcttttttcaaaactgtcttcttttttatttgttgttccttctttgtatttccagtgagcagcgataccgtattctgccgttctgtgcatttcatatgttcttatttgtatttcgaaaggttcggagccttttgtgaatacagttgtatgcaaagattgatacatatttggttttggcattgctatataatctttaaatcttccgggcattgggttccatagtgtatgagccataccaagaactccgtaacagtcttttactgttttaactagaacccttattgcaaataaatcatatatttcttcaaaggcttttccttttttcatttttctgtaaattgaataaaaatgtttaggtcttccttctatttttgcttcgatgtcggattcttttaaaaccttacctaacatatatttaacattatctataaaagcttctctttcttctctttttagtgcaacttttcttgctatgtcgtgatatgcttcagggtcaaggtaaagaagagccaagtcttcaagttcccattttattttagagataccaagacgatgggcaataggtgcataaatatcaagagtttctcttgctttttgtttttgtttatccggtctcatggctgatagagtacgcatattatgaagtctatcggctaattttattataacgacccttatgtcgttagccattgctataaccattttccttagattttcggcttctctttgttcttttgttataaattgaagtttgcctatttttgtaactccgtcaactaaatttgctattgtttgattaaagtttgtttttatcatttcataacttgcaggagtatcttctataacatcgtggagaattgccgcacaaatggtatccgtatccatgtgtaaatccgttaaaataaaagctacttcaagagggtgagatatataaggttcccctgagtatcttgtttgatttttatgtgcatcttttgcaagcaaataagctctttctatgatttcaaaatttgcatcttttgaatattctcttatactgttttcaagttttctaagaagttccataggcatcctcccaaccgactaaacattacatgtttagtccttttttgttatcttttataataacacaaagtgagcatctgttcaactttatttaatgtaaaataaacctacagattaaatatttatttagtatataattgattttaaagggtatatttggtaatataaattattatagctttttatttaaggagagtgtgataaatgagtaaaaaaccatattatatttcaacagcaatcgcctatacatcaggtaaacctcatattggaaatacttatgaaattgtattggcggatagtatagcaagatataaaagaatgactggatatgatgtttatttccaaacaggaacagatgaacacggtcagaaaatagaaacaaaggcgaatgaagccggaatttcaccaaaagaatttgtagataacgtatcaggcgaaattcatagaatttgggatattatgaatacaagctatgataaatttatcagaactacagatccttatcatgaaaagaaagttcaacaaatatttaaaaaattatatgaaaaaggggatatatataaaggcgtatatgaaggaatgtactgtgaaccatgcgaatctttctttacagaaagtcagcttgttgacggaaaatgtcctgactgcggaagagaagttacttatgaaaaagaagaagcttatttcttcaaattaagcaaatacgctgacagattaatggaatatatagattctcaccctgaatttattcaacctgaatcaagaaaaaatgaaatggttaataacttcttaaaacccggacttaaagatttatgtgtatcaagaacaagttttaaatggggtatacctgttgattttgatgaaggtcatattgtatatgtttggattgatgctctttcaaactatattacattccttggatatgatgttgatggaaaccatgaagatacatttaagaaatactggcctgcagatgttcatttaattggtaaagatattttaagattccatacaatatactggcctataatgcttatggctcttgatatccctcttccaaaacaaatttttggacatccttggttacttcttggtgaaggtaaaatgagtaaatcaaaaggtaatgttatttatgctgatgaccttgtagatgtatttggtgttgacagtgtaagatattatcttttaagagaaatgccttttgctcaagacggtacactaacttacgaacaacttattgacagagttaacggagaacttgtaaatatattaggtaaccttgtaaacagaactttagcaatgagtaaaaaatactttgatggtaaagttacaaatcctaatgttaaagaagatgttgatgatgatttaattaaacacgttacagatacaccaagacttgttgaagaaaaaatgaatgaattaaaagttgctgatgcaattaatttaattattgctcttgcaagaagaagtaataaatatattgatgaaacaatgccttgggtacttgctaaagatgaaagcaaagcagacagattaaaaactgttttatataatcttttagaatcaataagagttatcggtattttaattacacctttcttgcctcaaacaggtgaaaatatcattaaaatgttaaatacaaaaaatgattcttatgaaagtgtgttaagttttagtggtttagaagaagacatagttttaaatgaatcatttgtattatttaacagacttgatccaaaagaaattatgaaacaagttggtaaagaagaaaaacaagaaaagaaaaaagataaaaaagaaaataaaaaagcaaagaaagaagaacaagaaaatacagaaattaccattgatgattttgcaaaagttaagttaagaacgggtaaaatagtaagtgcaagaaaacatcctaatgctgataaattattggtatttgaagtaatggttggagaagaaaaaagacagattgtttcaggtattgcaaaattctttacccctgaagaagttgtaggtaaaaatgttgtagtagtagcaaacttaaaacctgcaaaacttagaggtgaagtttctgagggaatgttacttcttgcggaagataaagacggaaagcttacttttgtatctcctgaagaagatattgaaagtggattagaggttagataatttatatggcttataaagattatactttacaagattttgttaataaaacgtacagcaaagaccctgctcccggagggggcggggtctgttccttatgtggctctttaggtgtggcattgtcgggaatggtttctaattttacgacaggaaagaaaaagtatgcacagtatgaagaggatattcaaaaaataataaaagatgcaaagagacttcaagaacgatttttatctttgatagatgaagatgaagagaattttatacctttgtcaaaagcatatggtttaaaagcagaaagtgatgaagaaaagaaatttaaagatgatgaaatttcaagatgttccgttattgcatgtaaggtaccaatagagattatagatatttcctatgaagcaatattacttcataaagaacttttaacaaaaggttctgtgttgttaataagtgatgttggagtaggagttgaatgcttaagaacagctttaaaaggtgcttacttgaatgtattgataaacatgaaaacaataaaagattcttcttttatagaaaaaaatttgaaagaatgtaaagataaagttgatagtggcttaattttgtgcgacgaagtatatgataaagttttggatagactaaatataggagaataaaaaatgacaaagaaattgcttggcagcaaagttgtaaatgaaataataataaacagcaaaaaagaatgtaatgagttaaaggaacaaggaataaatcctcaaatagcagttattagggttggaaataattctagtgatatttcatatgaaaaaagtataatgaatttcatggaaaaagctgacatatccgtaaaatcaatagtattagatgagaatattaaggaagaagaattcattaatatattaaaggaagtaaacgaagatgaaagtataaatgcaattttggtatttagacctcttcctgatcagattgatgaagataaaataaaatatataatttctccaagtaaagatattgactgtttctctcctgtaaatatggcaaaactttttatttcagatacaagtggtttttatccttgtacacctcttggagttatggaaatgttagattattacagaataaatccagaagggaaagaagttgtaattgtaggtagaagtcttgttgtaggaaaacctttaagtatgatgcttttagacagacatgctactcttacgatttgtcattcaagaacaaaaaacttaaaagaagtatgtaaaaaagctgatattttaattgttgctgttggaagagcaaatatggtagataaagaatatattaaaaaagatgctgttgttatagatgtaggaattaatttttatgatggtaaattgacaggtgatgttgattatgaaagtgcaagtgaagttgcaggtatgattactcctgttccaggcggagtaggaagtgtaacaacggcttgtcttgttaaaaatgttttaaaagcatgtaaacaaaaaaacggataatttatccgttttttttatcttgaatatttttttctttttcttacaaatgtagatggatccatatttaaacttgccgctgcctgtcttacatttttatatttttcataagccttatttatatatgcaagttcaatttgttctataagttcttttaaattgtctgttttaggaagtttaaaatcttttataatgtctttattatatttaggaaagtttaaatcttttgtcgttactacattatcagaaagtattaatcctctttctactacatttcttagttctcttatgtttcctttccattcctgttcttttaaaaattcaagtgcttcctttgaaaatgatttgttaaagccatattttttattaaatgtatctttaaataaatttataagagagataatatcttcttttctttcttttaaaggcggaatatatatagggaataccattagtctataatataaatcttttctaaatagtttcttttccacaagttgttcaaggtctgcattagttgcggctattattctaacattaacttttatggattttgttcccccgactctttctatttctctttcttgaataactcttaaaagtttcacttgtaatgaaagaggaagttctccaacttcatctaaaaacactgttccgttattagccgcctcaaatattcctgcttttccttttttgtctgctcctgtaaatgatcctttctcatatccaaaaagttcactttccgcaagagatggggatatagcaccacagttgacttttataaaaggttcattttttctgttactgttatttaaaatataatttgcaaaaagttctttacctactcctgtttgtccaataagcattaccgttgtgtcaaggtctgcaactttttttgcaatatttaaaacttgctttgaattttcatcaacacaaataatcttttcattttctttaaaatcagttgattctatatttttattttcgttttttaagaagctgtttttttctacttctttttttaatttgtaaatttccgttaaatctcttacgtttgttacaaccattattatattaccctttttgtcaaaaacaggggagcttgttattagcgcttttttcccagttttaaattcttgttgaagggttattggttcttttttttgaagagccaagaccgaacctgatatggatatgacattattttttataaggtcaatcatgtttttacctaaaacttcttctttttttaagcctgtaattacctcataagatttatttacttttattgtatttgctttattatctgttatataaataccgtcaaatgagttttctattattgcatcaagtctttcatttgcttcttgaagattattaaatatattattttccattttacacctcgtatataattgtattttactatgcatgttgcaagaatgcaacaatctatttttagtaatataagcaataaatatatttgaaaaaaatataattgttttatataatttggtagaggtagagttatgttaaaagatgataaaataatagaaatagaaaaagttttaaatgataaagttcgtccttatttaaaaaatcacggcggtaatgttgttataaaggaatataaagaaggaatactgaaagtaaaattaataggtcaatgtgcaaactgtgtaagtgcaaagacaacaaatgaagaacttataaaatataacttattaaaagaaataccaagcataaaagatgtaattcttgttgagggagtaaatgacgaacttcttgattttgcaaaaaattttctaaaagggaaataaaatgaacgtatatttaaaatactgtggcggctgcaatgaaacatataacagggttagtgaagtggaaaaattaaaaaaggaattccctgatttttgtttttattatgatgataatcacatttgtgatattgcgcttattgtatgcggatgtaataatgcttgcgtttgtatggataaaataaaaattgaaaataaatatattttaaaggataaagaagatttttataaaataaaatctgttttattaaataaattacaagggaattgattatgggtgaacttagaaaaataccaggtgtagggaagaaaacagaaaaagatttaataatgttagggtataaaaatattgagtccttaaaaggagaagatcctgaaaaatatatttaaaggaatgtgaacaaaaaggctgtaaagttgacaggtgtcagctttatgtatatagatgtgctgtgtattatgcgaacgaaggaaaagatagagagaataaaaagtggtgggattttaaagataaataatactagtatttgacatattatgttgtcagtggtaaaatattgtgaaatcaaaataatacaaataagctaggggagcctatgggctgagagaactattcgtgtttacccttactacttgatccgggttatgccggcgtaaggaagctaaatattttcttaacccctcctatgtttataaaaggaggtatttttatgtcaatttttgtatcatctacacctgacggttatatgccaacaacaataggatatataactttagcagttttacttattgctattttggttataggtgtatatttatcaaaatcaaataagaaagaaaaacaaaaaagtatcagtacaaaaaaaatggttttttgtgcaatgattattgctcttggaacagtagcatcaatgcttaaagtatatgagtttccatttggaggttccgtaactttatgtagtatgttattcgtatgtttggcgggttatttttttggtcctgcaacaggtattttaacaggtgctgcatatggtattttgcaactgattattgaaccttacatagtttttcctttgcaggttatcgttgattatttacttgcttttggggctcttggtttatccggaatattttataaatcaaaaaacggtttattaaagggatatatagttggtgttatcggaagatatatttttgcagttctttcaggttttatattttttgctgaatatgcttgggcaggctggtcgccacttgcttattctttggtatataacggaatatatataggagctgaagcaattcttacaattattgtaatttcaataccggctgtaaaaaaaggatttgaaagagttaaaaataatatttaaggaagaagtgttttacttcttcttttttattattaaggagtgctttttgaactttgtaatatatttataatttagtttttagtgttataattattttaatatagtttggaggaatgttatgagtataggacaaagaatagcacgtgaaagaagaaatcttaatttaacacaagaacagctttcagaaaaacttggagtatcaagacaaacagtttcaaaatgggagcaggatattattttagttgggacaaataagcttatagaactttgtgatatacttgaggtaagtatagattatttattaacaggtgaagaaaaaaataataagcttgaagtaaaaaacggagaaaaagggcttgaaatagactggactaaagtttatcctattttaactaaatatcaagatgaaatagatatggattactatttgtctcattttgagaatatgataaaagaagctatgaaaaaatatgattattctcttgaagatgctgtgcttgttttaaaagatgtattttataaagcatttttaaatattgaaaaaaaagaaaaggactgttaaacagtccttttttattcatcatatattggggtaactaaaggttttccgtctttgtttagtaaaggggtaagtcctcctgcattaccatcaaaatggaataaataatttactcctgtttctctgtcaacccaaatttcattaccttttattgttccttcactatgaacttttatgaatctttttttcattgttatttattgcttcttctccagatgttcattttttctgcttctttaataagttcttctctgaagtcaggatgagcaacactgattaaagcttcagctttttgccatgtagaaagtccttttaagtttactttaccatattctgttacaacatagtgagtatttgctcttgtatctgtaactactgaaccagggtgaagtgttggtaagatacgagattttaattcaccttgtttgtttttgaatgtagaagataagcagataaagcttttacctccttttgataagtaagcaccaagaacgaagtcaagttgtccgcctgctccagaaatttgttttgttcctgaagattcagagcttacttgtccgaataagtcaatatcaacagcattgttgattgagatgaagttatcatgttcagagataactcttacatcgtttgtataatcaacaggaactgacatacattctgggttgtcatttaagtaatcatataatttttttgtacctgctgcgaatgcatatgtttgacggaatctgtttaagttctttttagaaccattgattttgcctgcgtttgcaatatcaacaaaaccgtctacaaacatttctgtatgaacaccaaggtcttttaagtctgattctgcgattaaagaaccaactgcgtttggcattccaccgataccaagttgtaaacaagctccattagggatttcttcaacgattagttttgcaactgttttatcaacgtctgttgcagctccgccgccacccatttcagccattggagggttgtctccttcaataatcatgtctacatttgagatatgaactgcagattcaaatccgcctaaacatcttggtacattttcgtttacttcaacaataattttttttgctgtttcgcatacagccattaagtgtgaagcacttggtccaaaactaaagtatccatggttatccattggagaaacttgcataatagcaacatctgctcctggagtatttccatctctatagtatcttggaagttctgagtaacgaattggagaatagaatgaaaatccttttgctacagcttttctttcaattccgcccatatgccaagagttccatgtgaaatgatcttttgcatcttcaagtttgaagatttcaggttcccacattaagataccgcctcttacgtttacgtcttttaagttaggcattaattttgctaattctttgtcgaatgcaacaggagttgttgctgtccaaccgtaatcaatccaatcgcctgattttactgtttttgctgcttgttcagcacttactaatttttgttcatattcttttttataatccatattagtatcctctcgtttatttgaattatatatattttatcattaataactattaagggtcaatagcttaaagttttaaatcagtaaaaaattacttatttttttctcattttatttcttattcttatatctgaactgataaaatgtaaatatttaaaattacttactatccttgaatatattcttgatttgtatttatcgcttatttcattgagattaagatttgttgttattatcatttttttattgtaagtgattctataatcaattaattttaatatttcattgttaacatattcactttgggtttctattccaaggtcatcaagaattaataaatctgcatttaatatattttgtttatcttcttctaaagatggattagagaaattttttattgcatcttcaaattctcttgcagttaaacaaacaacactatatcctttttttaataaaacctttcctgttgcagctgcaagaaaagtctttccacttccaactttacctgacattagtaaacctatgttattattactgtcattaaattcatttataaaccttaaagattgttgtttattttttaaaatattttcccttggtgatatttctcctttttttgattcattagtaaatagattttcattaaattcttcaaagcttccctttctaaaaagtaaagggtgaggttttacattaaaatgtaaaaattcttttaagcaatcacacatatgtccgtttatatatcctgtatctttgcatttattacagtcgtattttacctccaagaaattttcatcaaaacccttttttattaattcttctcttaattgattatttagttttgtttctttttctttgtatttttcactacttagattaccaagacaagcgcttattccaagttcgttaatttcgttaaggattttctttattttaggataattttgttttacataatctatttttctttctaattctttttcttttaaatgtcttttattgttaaaatcaatcatttttttttcattaatattcatgattaatcctcactcatcatttttataatatcttcttcattataatattcataatcaagatctgcttgtatcgtttcttttgtacttgaaggtttattatattgtttattgctgttttgaggttttgtgtttttatctttgtttatatacatgctataaattacactatcaacatatttaaagcttggtttgtttgttgcaatggtttcgtcacaggcttttaaaatttgttccatgcttaatttatattcatcaagccatttatccacaagattttcttcaggttttgtaataaatgttcctcttgtattaagtccaagatatttaaatattttttgatattcttgatatcttttatcgcttttgttaaattccattgcggcttcgtcaaaggtttttattccttttgagtggaagtccattgccactgcattccaatattttctttgttttattttccttttaataagacatgtatttactattaatttaacggtttctgtactaaaagaataatcttccatccagtcagagaacatttccatttcttgatgtgatatcggtcttccaagtccaccttcctcaatggaagcttcaaattctttactaagttcgtcaaataaactttgttttttggtgttatattctattgtttcgctgtaagaaccgtttttcttgaatttttcaggagtaaatatcatggtagagatatttttatattggatgacatagtttcttttatctgtatgaataaaagttaaaacttgtttttcatgccaatatttaaacgcttttactacatcaccttcactcattccaagagtgtttgcgatttttttatttgaaggcatttcggcaattgagctttgtgtacattttagtccatataaatatactttgacataatctcctcttgccattggcataaagtggtttataaaaatattttctactattgttacacctatatcatcgttgttgtttataaattcaaatctattcatttaaaatttctccaaaataaagtaaaacaattatagcatattttgtaactttagtgtagaatataatatgtattttaattttacgaggtagtaaatgattagtaatttaaaagttagcgataaggtattcgataattttattttaaagagcgttatgcttagaaagacaagaacaggtaaagattatcttgatataatccttaaagataaaagcggtgaaattgccgcaaaattatggaatgtggaagaaggtcaaaaggatagttttaaagccggtgatgttgtaaaagtaagcggagaagtagacagctttggttcaaatcctcaagttaagattgaacatattgaaaaagttaaattgaacgatgaagaaatgaataagcttgttgaagccgctcctttgaatgctgataagatgtttgaagaaattattttaactataaataatttcaaaaataaggatattaaacttatcacaaagactttaattgataagtatgaatacaaatttaaaacatatcctgcggcaaaatcttttcatcatgcaatgaaaagtggactattatttcatactttcacaatgcttacaaatgcaaaaaaacttagtgctacatatacatttttaaatacggatttgctttttgcaggcgttatacttcatgatatatgtaaaacagaagaaatggaatgtaatgatttgggagttgttgaaagttatacaaaagacggacaacttcttggacatataattcagtgcatttgtgaaatagataatgtaagcagaaacttaaatattgaaagcgaagttccgcttttgcttaaacatatggttctttcacatcattatcatcctgagtttggttctcctaaataccctatgataccagaagcagaaatgcttcattatcttgatattttggattcaagaatgaatcaaatgcaaactgcttttaatgctacaaaagaaaatgaattctcaagcagggtaagaatgcttgataacagaaacatatatcactataatatagaagatacaaaggaggaataatatgagtgtacaacttgcggcttcattagttatattttgcataggatatttcggtatgcttgcaataaaagttataggattttcaaaaaacaataaaaaattaggaaagatggtttatgcagcaccaaaagggcttggtaatactgattgtaaatggcagattttatatttgattttggtaattgccgctatattggttcttgatatgttcggtttgttaaatgctacaatattcttttattgcatgggactaattggcgtttattttgggtttgcaacttattctatttttatgtgtatacttggaggaagaggtctttatcaatatggtgtaaggtcaatgacaggtgcgttggtatatgaaaaaatagattcatacgaaattttacaaagaaaaggacataaaggtctatcattaaaggtaaaacctaaatcgggaatgttaaacgcaactcaaattatgtttttagattatgaagataaagacgatgttgataaaattctaagagttaatgtaggagtacaaggcaaacctgcaaactattatggtgtaagacctaataagaaaaaaagaggaaaaagaagaaaataacattataaaaccatgtctattaggcatggttttaatttattttacaaaatatattctttaatttaaaagaatatagctttttaaaaatctgtatgatataatttaaaagttatacgggaaatatttataaatttttaggaaatattttaaagaggtaaattatgtttaaagaagatacaattgctgctattgcaactccttcaggttatggtggggtttccataataagaataagcggtagcgaagcttttgatgttacagataaaatatttaaaatgaaaaataaaaccatacatgatgttaataaaaacaccataaattatgggcatataatagatccaaaaacaaatgaagtcgttgacgaagttttggtatcaaaaatgtgtgcgccacattcttttacggcagaagatgtaattgaaataaactgtcatggaggtatgagcgtgacttcaagagttttagcattggttttggaaaacggagcaagacttgccgaagcaggagagtttacaaagagagctttcttaaatggtagaatagacttggttcaagctgaggcaataagtgatttgattatggctaaaacaaacagttttgcaaaaagtgccatgaattctttaaaaggggatttatcggaaaaaatagatgaaataaaggcagatattacaaatatgcttgcaaggcttgaagtaaccatacagtatcccgaatacgatgaagaagatttaacggataatgaaattgttgatttaatagaaaaaatgtcttttaaactaaagaaaattatatcaacttttgaaaaaggcgaaattcttaaagaggggataaaagttgccataataggaaaaccaaatgtagggaaatctcaacttttgaatgcccttataaacgaaaataaagcaattgtaaccgatgaggcaggaacaacaagggatatcgttgatgaagttgtaaatataaaaggtgttcctgttaaattcattgatacagccggaataagaaatgccgataataaagttgagcaaataggaatagataagtctatatcaatgctcgaagatagtaatataatattattttgcatagattcttcccgtgctttagatagtgaagatatagaaataataaaaatgcttcctgaaaataaagatataattgttgttttaaacaaaatggatttagatgtaaataacgaaacaataaatgcttttgaaaattataaaacaatagaaatatctgcgctaaaacaagaggggatagaaaaaatcgaaaaagcaatttatgatatagccaaagtaaatgataatgacgaagttggagaaatccttgtaagtaacgtaagacataaaaatcttttacttggagcaaaagaagattttgatcatgccatagagatggttcactccggattagaagtggatttggttgaaatagatataaatgctgctctttcaaaattgggagaaattaccggagaaaccacaagtgaagatattatagatgaaatatttaagaatttctgtttaggaaagtagaggtaaatatgagttttttagctggagaatatgaagtaatagttatcggtgccggtcatgcaggctgtgaagctgctcttgcaagtgcaagaaaaggaagcaagactcttcttttaacattgaatttggaagctcttgcaatgatgccttgtaacccttcaataggcggtacggggaaaggacatttggtaagagaaatagatgccttaggcggtgaaatgggtaaaaatatagataaaacttttatccaaatcaaaactttaaatactgcaaaaggtgtagccgtacagtctttgagggcacaagccgataaaaaaagatatcaggaagaaatgaaatttgttatagaaaatactgataatcttgatttgaaacagcaagaagccgttgatattttaacagaagacggaaaagtaaaaggtattgttacaaatacaggtgcaatatattacacaaaagcaattgttctttgttcaggaacatacttaaaaggaagaataatcataggtgatgtaagttattctggaggtcctaacggtatatttgctgcaaataagttaagtgacagcttgaaaaatttaggttttaaattattaagattaaaaacaggaactcctgccagagtaaatagaagaagtattgatttttcaaaaatggaaattcaatatggagataaagaaataacacctttttcttttgagaatgaaggtaaagatattgaatttgatgaacaaccttgttatcttgcttatactaacaaaaatacacatgatgtaataaaagcaaaccttcaccgttctcctttatacagtggaaacataaaaggtgtaggtccaagatactgtccaagtatcgaagataaaatcgttagatttgcagataaagaaaaacatcagctatttgtagagcctgaagggttaaatacaaatgaaatgtatcttcaagggatgagttcttctttacctgaagatgttcaagttgcttttttaagaactattaaaggacttgaaaatgttgagataatgagagttgcttatgcaatagaatatgatgcaatagaacctacgcaaataagcctttctcttgaaagtaaagtacttgaaggtttctttacagccggacaaataaacggtacaagcggatatgaagaagctgcggcacaaggtataatagcaggaataaatgcttctaattatgttcaggaaaaagaacctttagttcttgacagagcaagtagttatataggtgtattgattgatgatattacaacaaaaggaacgaaagaaccttacagaatgtttacctcaagggttgaatatagattattattaagacaagataatgcggatttaaggcttactccttatggttatgaacaaggtcttataagtgaagaaagatataataatttaataaaatataaaaatgccgttgaaggtgaaaaagagagattaaaaggaattaaaataactcctaacaaggaaaataatcaaaaactcgttgaaattggaacaactccattaagaaatgccgttactttatatgatttgattaaaagacctgatctttcatataaggatacgattgtttttgatgaaaacagaccggctctttctaagagaatttgtgagcaggtagagattcaaataaaatatgaagattatattttaaaacaacaggcaagcattgaaaaattcaaatcgatggaaaagaaattattgcctgatgatatagattataatgaaataaagaatttaagattggaagcaagacaaaagcttgaagatataagaccaaaaaatttaggtcaggcttcaaggatatcaggagtttctcctgctgatataaatgtgcttttaatcgagcttgcaaaaaataccaaaaggggagaataaagtgtcagataaaaatataaaagaaattaatatagaatcaatcaaagcaaataaagagcaaccaagaaaatattttgatgaagaaagtataaacgaacttgccgaatcaataaaaagtttaggtataattcagcctattaccgtaagagaaagtgaagatggtttatatgaggttgtaagcggagaaagaagattaagagccgctaagattgcaggattagagaatattccttgcattattgctaatataaacaatgaagaaaatgatttaatagctttaattgaaaacattcaaagagaagacttgaatttttatgaagaagcattaagttataaaaagataatgagcgaatatggtatcagtcaagaggcattatcaaaaaaaatagggaaaaaacagtctacaatatcaaatttagtaagacttttaaaccttgatgaagaggttttggaaataataataaaaaacaatcttactcagcgtcatgcaagatgtcttttatctcttcctgatagaaaaatgagagtaaaggctgcaaaggaaatggctaaaaaagatttaaatgttaaaaattcagagcttttggttgaaagattaaaacaggaagttattgttaattcttcaaagacaaacgtaaagaatatttttaattataaaatatacacaaataccataaaacaggcttataaaagtatttttaatacagggcttgactgtgattataaagaaaaagattatgatgacagaattgaagttgtcataacaattcctaaaaaataaagcatactcagtatgctttttttagttaataaaaatttaattttcatttaattttttgtttattgcctgttatgtcgaaatttgatataatcactccactgaatatgaaagaggcatttgctatgaaaatgagaattaataaaaaatatgttttttttggaataatagcattaatttgtttaattggagtgtttaaaatttttataagtccattatctttaaaagataagagtgttgaagttgaagttaaacatgcatataatcctgaaagtaatataaaatatgttgttttcggggataaaaaagatgttttaatagataggaagaatttggatacaaataagataggggattatgaaattatatataagtataaaaataaagattatcccgttacaataagtgtcgttgacacaacacctccttcttttaatgtaaaagaaattaccatagaaaacagagtaaaattagacccaaaagaattggtgaaagatgtaaaagatgcaagtaaaacaaccgtatcctttaaagaagattataattttgatgatgtaggagattatgaggtagaggttgttgtgagtgatgtttacgaaaacagtacaagtaaaaatactatcgttcatgtaattgaagataataaaggacctgagattaaaaatgtatctgcaattgatgtagttgtgggcggggatgaaagttgggaaaaggatgttattataaaagatgatcatgatccaaaccctaaacttattttggaaaaaggagattttaatcctaacaaagaaggcaaatattttgttacatataaagctgttgacagagcaggaaatattagcattgtaaaaagagaagttaatgttgtaaaagctattggaacaacgagtgaaagcgaggaaaaaatagtatacttgacttttgatgacggaccttcttccaatactaagaaaatacttgatatacttgataaatatgatgcaaaggcaacttttttcgtaacaggaaacaataaacaatataattatttaataaaaacagctcatgataaaggtcatactatagggcttcatacatatactcatgactatgcaaaagtatataaatcaaagtactcatattttgatgatttacataaacttgaaaacatgttaaaaggcattatcggttattctcctaaatatataagatttcccggagggtcatccaatactataagcagtgcctataaaaaaggtataatgacttatttaacaaaagaagttcaaaacagagggtatcaatattatgattggaactgtgattctacggatgcctccggaaataatgtagctgtaggtaagcttgttgaaaatgcaaccaattgtagtgaaaacaatattaatatactttttcatgatacagatgcaaaagatacgactgttgaagctcttcctaaaataattaagtactacaaacaaagagggtatgtatttagggctattgataataactcttttgctccacatcatggtgtcaacaattaaagaacacgtttttgccgtgttctttttgtttttatatttaataaaataatggttgacttttgattggttttgatttattataagagcataaaaagaacaatttttcaaatattgaacaaatgtaaaaataaattgaatagaaattaatttcaacggaaaggaatgagaagaattttgaaaaaggtttctgatgatactaagttaatggtaaaagtatgcgatttgtattacaacaacgacatgaaacaagaagaaattgcttccaaactttcaatatcaagagcgacaatatccagaattttaaaaaatgcaaaaagtgaagggattgtcaaaatagaagttataaatcctttgaaaaatgattattacaagctagaaaaacaattagaagaaaagtttaacttaaaagaagtcataattgcagaagatgttaccgatgcttcatatgaaagggatgcacttggtaaagcttgtgctgaatttttacaaagggttttaaaagatggggaaattgttgggttatcaatgggaaaaacaataaagactatagcacaatatgttcatcaagataaaccaagagatatttcttttgttcctctacttggaggtatgggacaagttggtattgaacttcattgtaatcaaattgtaatcgatttttttagagcttttggaggagaatatcatcttcttcatgcaccggcaatgatagcggatccaaatttaatgcttagtttaaaaaatgatattcatataaaacaagtatttgatttgttggataaaattacaaccgcagttgttggtataggtacggctgttcccggttcgacaatgatggaaacggggtattacaaaaaagaagacattgttgaaatgaaaaatagcggaattgtgggagatatatgtcttcaaatgtatgatatagaaggtaatacaaattattcgtacaataatgatatattcggtataaatttagagtcattaaagaaagtaaagagagttgttgggataagtgcaggggaagagaaagttaaggcaataaagggagccttaaacggaaaaattgtaaatgttctcgtaacaaattcaagaactgcaaaattattgcttgaagattaaattggaggaatattatgtggaagatttttgcggttgcttttgttctaatggtatttaattccatattgacctataggcaggccaaagattttactatatcatttaatgaaattcgtaaatttggaaatgtaagtgttggtaaagataaacagtattttatttatggagttattttgattcttgcttgtgacagtaatggatatgttacaaaaggtaaaataatgaagggatttagtgtttttgcaagatttaataattttgatgctttaaacggaaaatctatttatgatttaaaagaagaagaagaggagaaaatgaaaaaaattagaagtaagagaagaaagaaaaaaggaagctctttacttcaggctgtaaatggtttaataggtgttttagaaaagaataaaactaacaatgatgaaattgagttgcaggaagaaataaaaaaagttgttgagtaaattgtatgttaagacaactgttgtctttcataaataaaaaatatagaaaggagaatttttatggaattcttgacaaaacttgcagaaggttttatcggactatttaacgcaggaggtgaaacttttgttggatgggttacaggtatcatacctactcttatcgttttaattacagctataaatgctttaattaagattatcggtgaagaaagagtagataaagctatgaaagtattatctaaaagttttataacgagatatactttgatgcctgttttagctatgtttttcttatgtaatccaatggcatattcatttggtcgtttcctaaaagaagaacacaaagttgcattttacgattctacggtttcattctgtcatccaataacaggactattccctcatgcaaatgccggtgaattatttgtttacttaggtattgcaaatggtattacggcattaggtttaagtactacaccacttgctttaagatatttcttggttggtgttgtcgtaattttaatcagaggtattgttactgaaagattatatgcaattatgagtagtaagaaaagtgcagatgcatagaaaggggaaaagatatgagtaattataaagcagttaagatcgaaaaaggttctcaaggttggggtggaccgttaattattaaaccaactgaaaagaaaaataaaattgccagtgttacaggtggtggaattcatcctcttgcacaatatattgcagacttaacgggagcacaagccgttgatgctttttctacaggtgttcctgatgaagaaatggctgtggttatagttgattgtggtggtactgcaagatgtggtgtttatcctaaaaaaggcgtatatacaattaatcttaatgctgtaggagctgttggaccacttgcacaatatattaaagaagaaatatatgtatcagacgtaaaagaaaataacgtaacattatatgaaggagaagttagtgatgaagaaccttcggctgttacacaagaagtaaaaccatcatctaatgaaaacaacggacctgaacaaaaaggtttagttggagtaattgcaaaaatagggaaggcagttggtggtgttgtaaacaaattctttgcagcaggtagagatgctattgatactacaataagaaatatcttaccatttatggcatttgttagtatgcttcttggtataatttctgcatcaggtattggggatgtaatagcaaaggcgataagtcctttagctggttctcttccaggaatgattgttttatcaataatctgtgcaattccattcttatcacctgttcttggaccaggagcagttattgctcaagtagtaggtgtattagttggtgctgaaattgcaaaaggaagtattcctccaacatatgcattacctgcattatttgctatagatgctcaagttggagcagactttgttcctgttggattatctcttggagaagctgaaccttctacagttgaaatcggggttcccgcaatgctattctctagacttattacaggacctattgcggttataatcgcatacttctgttcatttggattatattaatagacataaaaaattaaaacgtaaggaaagtacataatatgaattatatatcaaaaataaccggatttggcgacatggctttagattttttacaagaaaatatgcttatactgtttaatgatgatgctccagttgaacttgcggaactgtcagttttacatgaaaagcaagaattaacaagggatgtttgtgtgggagacattatttctcttggtgaagatgattatcttgttactgctgtaggctcagaagcaaaagaaaccttaaagatgttgggacattgttgtttggtatttggaggcaaagacagcgtagatcttcccggacaaatccaattaaaaggtgataaacttccagatttaaaagtgggagattatattaaaatacaatttttaggaggaaatgaataatgttaagaatgaattacaaattagcagagctagaagaaaaaaatgctcctattatgaccagtataataggagcaggacaaatgggcaggggcatgaccagtcaaatgatcaggatgaaaggtatgaagcccgcaattgttgctgacattaatatagataatgtcattgccgcatttgaaaactctggattaaccaaagatgattatattataacaaataaattaagcgaagccaatgcatatcttgaaaaaggtaaatatattgcaacagaaaattcagagcttggtgcaaaagcaaaccttattcaagctgctgttgatgctacaggggttcctgaagtaggggcaagagttgcaattgatgctataaacgaaggtaaacatatttgtatgttaaatgttgaaactgatgttgttattggacctatgcttaaaaaattagctgataatgcaggtgtaatttatacaggcagtgcaggggatgaacctggtgcggttaaagaattatatgattttgcaacagctgccggatttgatgtaagagttattggtaaaggtaaaaacaataaaatcgactatgatgcaaatcctacaacattagctgaatatgcagctaagagaggcgttagtcctaagatgcaaacagcatttacagacggaacaaaaacaatggtagaacttacagctatggctaatgcaacaggatttatccctgatatcagaggaggtcatggacctgaagctgaagtaaatgatttacctaatttgtttagacctactgaagaaggtggtattcttcaaaatggatacggaaaagttgaatgggtaaatggtattgctcctggtgtatttgtaatcatttcaagcgatcttccttttgttaaacatgaaatgaattacctaagcatgggcgaaggtcctaactgggtattatatagaccttatcatttatgttctttggaaacacctctaacagtagcaaaagcagttgttgacaatacttcaacattagttcctatggacggtggattagtttgtgaaacagtagcagttgctaaaaaagatttaaaagcaggcgaaatgcttgacggtattggtggatatactgtatatggtgttgttgatacacacgaaaatatgcttaaagataacggagttcctttgggagttattacaaagaatacaaaacttcttaaagatgttaaaaaaggtcaaacaatcacatatgatatggttgatttagatgataattcattaattgtacagcttagaaaactacaagatagatttttcggataaaataatataacattttgatttaaataaacccaaatatgaaatttaattcatatttgggtttattattttaattatattaaaaacataataaataatgttattaatataagtatataatgaatacagtaataaatgatatatattttaataaaatatgattaagagcattgtatatattttaatttgtatttatggctttgtaagttttatttgaaggagaatatatataactaacaatccattaacctatgtattatttattttgtttaaatggttttatatggagcttaaattattaatgttctataaaataagatataataaaatatatggaatttatttaaataaaataaaaagcggttttattataaaaccgcttttttgtaatatatcatttattattgtaatctgttaaataatgcaagaacagcatcatattgagggaaatctgtaggaagtataatagcatatccgtttgcaactgtaacattttctgttatttcgcttccaagggattccattgttaatttaccatctttttcagcatttttatatgcatctgaatctttatcaaatgtatataattctaaagttttatcatcggctgtaaatttaaatcccgcagttgcacctacaagttcgtacattgtttctgattctgttccttcgattccaagatttttaagttcagctttgaattcttctactgtgattttaggttcgcttgtttgtgtttcaccagaactgcttgtttctcctccaccgcatgcaacgaaagaaacagccataagagcaacaattaataatgctaataatttttttagtttcataatttattccctccttgaaacttatattataagttaatgatatcacaaaggaagagaaaaaatataaaaaaaagaccttgaggtctaacataaaaggatggtgccgaagaccggagtcgaaccggtacgatcggtaaggatcgcaggattttaagtcctgtgcgtctgccaatttcgccacttcggcttaagataaatggaggcggcacccagactcgaactggggatacgggtgttgcagacccttgccttaccacttggctatgccgcctaaaaaaaatggagcgaaagacgagattcgaactcgcgaccctcgccttggcaaggcgatgctctaccactgagccactttcgcttaagatggtgcccaagggcgggatcgaaccaccgacacgcggattttcagtccgctgctctaccgactgagctacctgggcataaaatggcgactcggaagggactcgaaccctcgacctctagcgtgacaggctagcattctaaccagctgaactaccgagccgcattcttaatattaattttttaatggtggtcgcaatagggctcgaacctatgaccccctgcttgtaaggcaggtgctctcccagctgagctatgcgaccattttttttgttgccactttttcagcgctgatttattatataacaatgcaaagattatgtcaagtataaattaacatttttttaatttattttttcaaaagttttttcgttataatagataacgttgaaaccctttattttagcagtgtttatgctttctttataatttgatggaatagataaaacactcttatttccatctgaaatatattttttatccggattttttttataataatcaaaataccagtacatatcttggtgttgtcctttatttgctatagctctgcttatataataaggatcaaagtcattttttattggatttgtaaaataaggtttttccggtgctgcaagaactgcgctttctatattgtatgaaatgtctttatatgttccgctttttacagcttttaatccatttttgtttggtttgtcaccatagggataagctaaataaacagtcttgtttttatttgtgttgttataaactaaattatttacttttcctatttcttttgttatttcgctgttacttagttcattcatattataatgactataagtatgatttcctatttcgtatcctaattcttgtaaaactctgaatttatccttataagagccttctgatttgctattatggtaagcatcatattcaaaaggattatttgttatatataaaactcctccgcttccaaaatccggatgttctgctttaaaattttcaagaatccctataagtgtatcatcatttactacaagttttccctctttattttttactaaggaaaaacagctttttaatccatcatcaaaagttagcaaaataggggttttcccagcaggaatatctatatcattgcttaaatactctttcatggaaattaaaacatatccgttttggtacatatattccaaatcttccctaaattcttttttgcttctgtgccatggatagtgattctttttatcatctatactgtgatacataataactaaaatatcaccggcttcgtttggtttaatatttttatagtcaatatctgtctttgatatatcttcttttatttctacttcgttttgagtatttatataagctgaaaatttatttatattaaaagatactaacgcgataataaaacaaagaagtactaaaattataatgtaatacctttgtttttttataaacatatttagattggtaatcttttttctgaaatcatcattatgtttatttttatttgacaattgtttttacctctctttttatttgttacattaaaatatatgttaagtagaaaaaaatattttctaattttaagatgttttttgctttttaacaagttatatgttttataacggcatatataaccattatggtttatttgttgtttttattttgttacttgttaataatattataacattaagttgttttaaatagaaataaaagtaaaatataaattataatattgacaaaacataattaccatgttaatataaaagcgtaaagacaggactatgtttataaagttgtttttacatttaagggtagacggttaaatacttaaagtttaaggaggatttttataatgaaacaaaaatataaccctttgatgttccaatgtagtgaaagtttagatatgagcaaatatattgttgctacatattatatgagaggtaaaggaaataatcctatggaacttgaccttgccaaatttgcagaatcaatagctgcagaacaagcaacaggtacatggattgatgttccttttgaaacagatgacattgttgaaagacatgctgcaaaagttattggtatttatgaaacacctgcttatgacagagaacttcctgacggaatacaatacagagatatgatagttagacttgctttcccttgggaaaacataggaactaacttcccaatgatttttacaactgcaataggtaatatttctgctgcaagattaaagcttgtagaccttgaattccctaaagaatatacagaccatttccaaggcccaaaatttggtataaaaggcgtaagagaaattcttgatattcctgaaagaccacttacttgtgcaatgattaaacctgatacaggttggactcctgaacaaggtgcaataatggcaggagatgcttatgttggcggtattgacgtaataaaagatgatgaacttcttgttgcggatcctgcatggtgccctattgaaaaaagagttaaagcaataacagaagcaggtctaaaagcttatgaacaaacaggtgaaaaacatttatatactgttaacttaacagaagacagctttaagattaaagaccttgcatacagagctttagatgcaggtgcaaatgctttaatgattaatacatatacagcaggtttctcagctcttagaatgttagctgaagaccctaatattcaagttcctattatgtcacatcctgactatgcagcagcacaatcttactctcctgatacaggtgttgccgtagcattactttggggtaaacttgtaagacttgccggagctgatatggcaataacaacaaactattatggtaagattcctgtacttagagattcttacttaagaacttgtagagatcttaagatgaaattccataatattaaagattgtcttcctgcaccaagcggtggaatgtatcaaggtgttgttccagaaacaatttatgaagttggtactgatgttatgattgcagcaggcggtgctgttcatggacacagaaacggtgctacagcaggtgcaagatctctaagacaagcaattgatgctgctatggctggtatttcattaagagaatatgcaaaagataaaccggatcttcaaatcgctcttgatgattggggatgtggtgaaaaagaagatttatttgatatgaaaaaataaacttttgagtttataacataacgtcatgttttcctcttaaaaaagaatataattattacccccaactatcgttgggggttgtttttttattattaaaaaagtattttaattgtcaagtgaaaaaccttgacaatgtcttttccttttgttataatcctttagtcagtataaggagagtagtatggaaaaatattttaagatgtcgtatttaatagatatatatgcatctcttcttactcaaaaacagtataaagtgcttgaatattattacagtgatgatatatcactaagtgaaattgcaagtattttgaatatctctagacaaggtgtttatgatactttaaaaagggcagaaaaaataatatctgattatgatgataaattacagttattaaataaatatgaacaaaacattaaaatgcttgaaaaagcagaagctttgattgataataaagaggctttatctttaatagagaaggtaaaggaaaacctataaggaggtttctatgtttcaggctttaggtgataaattacaagaaacttttaaaaagttaagaggaaaaggaaaacttacagaaaaagatatcgatgcagctttaagagaaataagaatgtccttacttgaagctgatgtaaactataaagtagtaaaaacatttgcaaaaaatttaaaagaaaaatgtatgggggaagaggttttaaaatctttgactccgggacaacaagttattaagatagttaacaatgaacttatcgatttgcttggaggggaaagcagagatataaacttttcatccactcctccgactgttatcatggttgtcggggtacaaggtagtggtaaaactacaagtatcggtaaaatgggtaactattttaaaaataaaaagaataaaaaagttgtgtttgtagcttgtgatattcatagagccgcagcggtagatcaacttaaaattcttggtgaaggtcttgatattgaagtattttcacttgatagtaaagatgcaggaaagattgcaaaaaaaggtgttgaatatgcaaaaagtaaaggcgccgatattgtaatcgtggatacggcaggtagacaacatgttgacagtgaaatgatggaagaagccgtaaaggttaagaaagttattaatcctgacgaaacactatttgtaatagactctttaatgggacaacaagccgtagatgcagcaaaagctttcgatgaaaatcttgaaattacaggtttcattctttcaaaacttgactctgatgcaagaggcggtgcggcacttagtgttacttatataacaaataagcctattaagttttctgcatttggtgaaaaaatggaagactttgaacctttccatcctgatagagtagcttcaagaattcttggtatgggtgacgttctttctttaatagaaaaagcggaaagcgtatataacgaagaagaagctaagaagatggaagcaaaattaagaaagaactcttttactttggaagattttcttgatcaaatggaaagcatgagtaaaatgggtggaattgaaagtatactatctatgcttccgggtgccggaaagcttaagaatttatcaatagatgaaagagagcttgtaagacaaaaggcaataatacagtcaatgacaataaaggaaagacaaaatccaagtatcatcaatgccagcagaagaaagagaatagctgctggaagcggtacaaaagtaagtgatgtaaataaacttttaacgggatttgaacaaagtaaaaaaatgatgaaacagcttaattcaggtaagatgagattacctaagatgaaattcccgtttatgtaacaagtcaaaaaagaaatttaatttctttaatataaaaatataattattaaaataaaaggagaaaaaacatggcagtaaaaatcagattaaaaagaatgggttcaaaaaaacaaccatactacagaatcgtagtagcagatgaaagaacagcaagagatggtaaaagcatcgacttaattggtagatataaaccagttggagaaaaaagcattgaaattaatgctgaaaaagctcaagaatggttaaacaaaggtgctaaaccaactgatactgttgctaagttattcaaacaaaacggtattataaaataataggagaccaatatggttgaattaattgaaacaattgcaaaagctttggttgacagtcccgaagaagtttgtgtaaaacaaattgaaaaggaacatttaacagtaattaagcttaaagttgctaaagatgacatgggtaaagttatcggaaagcaaggtagaattgcgaaagcaataagaaatgttttaaaagctgctgcaataaaagctgataaaagggttgttttagatattgaagaataaaaataagaactcaaactattattgtttgggttcttttttatattctttttttatccattccattattacttttactatgtattcttgttcttcttgattaagttgtttatttttttgtatatggtgccatttatataaacaatttctgcagcatgttgctgtagcatgctgagcgatgaatacagggtggtttttagttggtgtttgttttccatcgttttttatgtactgtggtgctattcttttttctatgaagtcaaaagcatggcttttaattgtatttataccttttttatcaatatattctatatctttcttctttaaatgaaaactgcttctaaatttagattttgataaagcatttaatttatcttgaatgtatttttcgttcattataagttccttttataatatttattagatatatttatgttatacaagtcattatatgttttgtcaatattgtagctatttttttaatttatttattgggggataaaattttatgatataataaaaataattaaaaggaggtacgaaaatgaattttagatttgggcatacaagcataagagtctttgatttagataagagcttggagttttacgtaggagctcttggaatgaaggaaacaagaagaaaagattatcctggagatttttgtttagtatttttggaagatgttaacaaaacttgtgaagttgaactaacatataattatgatcctgaaaaaccatatgaaatcggaaacggatttgctcaccttgcattttatgttgaagatttagaagctgcgcacgatgaacttgccaaaaaaggatacaaggtaacagatttttacggattaaaaggaaataaaccaaattatttctttgttacagatcctgacggttatgatatagaaattatcagagagaaaaaataatttaaaaatttaaagaggtaaatttttatttatctcttctttttttattattaatttgttgacataatatttatataatagtatattgttaaaaaatatagtaaacagtaaatttttatatgatattgttagcaataactaatgtttagaataaggaggggagttatgtttaacataaatacaataataggaattctaattccgtttttaggcacttctcttggtgctggatgtgtttttttattaaaaaaagatatgaagcgaagtatgcagaatttacttcttgggtttgcctcaggagttatggttgcggcttctgtatggtctttattaattccttcaatagatatgtcagaaagcttgggtaaattttcttttttacctgcagcaataggttttattcttggaatactttttctacttttacttgataaacttattccgcatatgcacatagataattctaaagaggggatggaaagcagtcttaaaaaatcaacaatgcttgttcttgcggtaactcttcataatatacctgaaggaatggctgttggggtagtttttagcggatttttaacaaacagtgcaggtataactcttgcaggtgcaattgcattatcagtaggtatagcgattcaaaattttccggaaggggttgttatttcaatgcctcttataaatgaaggcgtaagtaaaaagaaggctttttcatatggagtattgtcggggattgtagagccaataggtgcgtttattacgattttattatcatcatatatagtatcatttttaccgtatttattgtcttttgctgcaggtgcaatgatatatgttgttgttgaagagcttattccagagtcttctattggaagtcactccaatttgggaactataggtttttctataggttttttaattatgatgattttagacgttgctttaggttaatataacgaggtatacaaatgaaaaaaaatatttttgtattaaatataaaagatataaatgaaataacattaaagataaaaaataaaattgaaactatggataatgttattattcaaaaagatttatatgagaataatattctaaaaaaaagtattagttttgattttaatgattataataactttaaaaatgaaattgctaataataaagatataactgttatttttgatacaaataaataccgtgattttgttgagttaatgtttgatgataattcactaaatataactttagatgaaaataatctagtaaatattttatttggtaaaaatagtaattataaaataatagatttaagaattgacgaaaatataaatatagattttagcggtataaatattattaaaaatattgataaaaataatttctcttctttaaaagaaaaacttttaaaaagttttagtgaaaacataataatatatgtaataaaagaagataaaacagataaaataaaattaaaagattttgatgaatcttttacagaagaggtttttacattagccatagataagcagaattttactgatgtaaaaggaagttttgatgcatttatggaacttattgattatcttagaagcgataagggttgtccttgggatagaaaacagactcataagagtttaaagaaacatttaatagaagagtcttatgaggttcttgatgctcttgataaggaagatatgaatgccttaagcgatgaacttggagatttacttatgcaaatagctcttcatagtcaaatcgctaaagaaagtaaagaatttgattataaagatgtaattttaaatgttgcaagtaaattaataagaaggcatccttatgtgttttcagatactattttagaaggtgatgacactgctgctgtttggaatagtgttaaaaaggaagagaagtcttttgtaaattttagacagactttattagatgttccaaaaggttttccggcacttttatatgcgcaaaaaattcaaaagagagcaggggatgcaaattttgattttgcagattataaagaagctttaaataaactttatgaagaaattgaagagtttaaaaatgaaatagggaaaaatgaagataacctatttatggaagccggggatttgctttttagtgtagtaaatgttttaaggctaatgggaataaactctgaagaggctctgaattcttctacaaacaagtttataagccgttttgttttaatggaagaactaatcgaaaaggatagtaaaaatataatgtgtttggaccaagaaaatttggaaaaatattgggaaatggctaaaatactattgaaataaataatttttttggtaaaatataatctagagtttaaaagttgatatatcaacaaaaattaatttggaggaaaatttagaatgaataaatcagaattagtaagcgctttaagcgaaaaaactggacttacaaaaaaagaatgtgatagctgtttaggagcatttattgaaactgtaacagaaacattaaaaaaagaagataaagtttcattagtaggtttcggtacttttgaagtaagagaaagagctgaaagaaaaggtatcaatcctcaaactaaagaacaaattactattccagcaagcaaagctccagttttcaaagcaggtaaagctttaaaagattctttaaactaattaaattttttaatataataaaataaaaagatacctaatatataaggtatttttttattgttctttatgttataataattttactaaaaaatgggagtgatacgatgccagagtacgatgcaattatacttaatttagacggcagtaaaaagttttatgaaataggttcatttgctgcatttatggaaagtgatatgaaatttaaggctgtttgtgcgggaggcatgggagccgtaaatgctgcttttttttctatgaaagatatggataagattgttaaattttggacaatggcagttggaaagaatttgtttaaagtaaacaatcttatagcaggtttatatgaacattcatggtctaagttatctaaaaaaagctttgttaaagagtttacaaaatttctatctacagataaaagattaaaagatcttaaaaaagctttaagagaatatataaatgaagatgatgtaagaaatagcgatattaagcttttttttgatgtaatagatttaaacacaatggagttttcatctttaagtattgatgatattcccaaaggccagcttcattcatatattctactttgtgtatgtttccctgaaatttcaaatatggactcaaatatggggggaatgcaaaattataatggtaatttaattgatgtacttgtggaaaatggatacgaaaatataatatccacagaagaaatggtagataaatcttcattgaaaaaaataacaataattaaaagcagtgactttttggaacttgaggataaatacagtaccgatataatgaaagagcatataaaaataggatatttgaatacattaaaagttttaaaaaaggtctgtggaaaatattattatataaattttgaaaatgattcttcttatactttatttgaaaagcatatgggagatagttttaatgataataaagattatttgattatggagcttttagatttagattctaacaataagaatttaataagaaaaactctttgtgatatgataagattttctgaatatagaaaagagaataatgctttaatttccttaatggaaaatttatctaacatattaggcattgaagaaaaagaaaaatatacctttacgaagttaaaaaatgaaattgaaaaaatatataaacacgaagttaattctcatttaagaaaaattgaagataagaactatttatcaaaaatgataaatagtaaagaagagattttaagtgtgaataaagataatttcttggattattttttagttcttgtaagtgcaaatccaagaaattatgaaagactttatgttaatatttttaataaaataaacgataaaatgagacttggcattgtaacattattatatttactatattaaaaaaagcaaggtgggtaccccttgcttttatttttttcttattgttttaaaaaaatcttttattaatgttttacatttatcttcttctattcctgcatatacttctattttcttagctttattgtcatttaagagattatatttgcttccacacgctccgtagtttatatccattgctccatatactactttatctattttagcgtttattatagctcctgtgcacataggacagggctctaatgttgaatatatggtgcaaccgcttaaattatatgtattaagttctttgcaagcctctttaattgctattatttctgcatgagccgttgaatcatttctctttataacttcattgtgggcttttgatattactttattgttttttacaataactgcgcccacaggaatgtcatcattgctttttttagcttcttctaaagctagaagtatatattcattcattagtgagataaaagtgtccttaatttttcatttttttctattattaataatagaggaagtcctataacatataggcttatagcttgtccaatgcatacgcttataaatcctgcaatgaatggaactgctgacattttgtataaaacaaaaccaacaaatataccgttaaaaagtatacttggaattcctacaaggtatttgttttttattttactggcaaccattcccgcaagtaaagtagcaagagaaccgaaggcgatatcgattattccaaaaggacttgcaaggtttgataaaatgcatcctacaaataatcccggaacagccgatggtgtaaagtataccaatacatttagagcttcagatattcttacttgattttctccaaaagcaagtggagagataagcattgtgcatactgtgtagatagctgctattattgcagcttttgtgataaattgaattttactgttttgcataattggctcctatccaccacaaaaaagctcttataaaaagagttcgtggtatttgttatatataataacaagtataacagccttaggtacccctaaagggtatatgaaaaaccatgaaaccacgacgtttcatataccagtaaaaacaagagggaagtccctcttgtttttgcctcttatactaaatgttattaaccttattattctactgtaacagatttagccaagtttcttggtttatcaacgtcacagtttcttgcaactgcaaggtagtatgcaagagtttgaagatatacaactgtaggtattacagttaaatcatcaattacattatctatatacattactttatttgcttctttttcaacatttgagttttgttcttttgcaaaagctacgatataagcacctcttgcaacaacttctttaatgttgcttaacattttttcaaataaagcatcttgagtacaaagagctataataagagttccttcttcaactaatgcgataggtccgtgttttaattctcctgcttgataagcttctgaatgaatgtatgaaatttctttcatttttaaagaaccttcaagtgataagaagtaatcaagacctctaccaaggaagaatacatcgtgtactttgaaatgttcataagctatttttttgatttcttcttcttttgctagaacattttcaacgtttttgtctattgtcattaagccgtttgcgattatttcaaaatcttcatcacttaattttcctgttagcttaccgaataataaagcgattaagtacatacttacaacttgtgtagagtatgcttttgttgaagcaacggcaatttcaggaccagcccatgtatataatacatcgcttgcttctcttgaaacagtacttcctactacgtttgttactgcaagtactctggctccttgagcttttgcaagtctcattgctgcaagagtatctgctgtttctcctgattgagaaattgaaataagaagtgtgtgttcatctataattggatttctatatctaaattcacttgctatatcaacttcaactggaattcttgcatatttttctattacatttttacctacgtttcctgcatagtaagcagtaccgcaagctacaatatagattttgttgattttatctaaatcttcttttgttattgtaatatcatcaagttttacttcgtgtttttcaacgtcaagtcttcctcttaatgtatctctgatagctcttggttgttcgtggatttcttttaacatgaaatgttcatatccgcctttttctgcacctgcagcatcccagttaacttttagaatttgttttccaactttatttccttcattatcataaattgtaatatcatcttttgttattacggcaatttcatcatcatcaagcaaatatatatctcttgtgtattttaaaaccgcaggtatatcacttgctataaagttttctccttcacctttaccgattattaatgggctgtcttttcttactgcaataagttcttctggatcatctttacacattattgcaagagcataagaacctgaaagtttttttactactttctttactgttgaaagtaaatcgccatcatccatatcttcaagtaaatgagcaacaacttctgtatctgtatctgaaataaatctaaaacctttttttacaagatcttcttttaattcaatatagttttctataataccattgtgtacaattacaaatttaccgttatgacttgcatgtgggtgagagtttatgtctgatggctctccatgagtagcccatcttgtgtgaccaatacctacatgaccgttaatatctttttctcctaagctttcttttaaattatcaagtctgcctttatgttttcttattgtaattttatcatcttcaaaaacagcaattcctgctgaatcataacctctgtattcaagctttccaagtccttcaacaagaatgtcactggcttttttgtttcctatataacctactattccgcacatattttaaataatctccttaaaaataattgttgtgtgatttttaagttttagcttaaatttgtccttaaaattacttttaagttttgttaagcattaaggaataacttttaaatcccaaagggtatccgccgaaatttcgataaaccctttacctcgtcaaccttaaaattttatttaggaattcggttcgggcgctttaactaaaaattcctatatataaacctcctttgtacattatatcaaaagaggagtaaatataaaactaaattaattattttttaatattcagaaaatttgcaaataaaaaaatgcttaaaaagcatttttatactgcgattacaaacgcaatggcatattctttttcgtgagaaatggatattttaaaatcttctatgttattttctttcatatatttttttgcattaccttctaattttatataaggacagttatcttctgttttaagtattgttatatctttaaaacttgttttatccattcctttttttaatgttttcattatggcttcttttacggcaaaatatcctgatatgctttttgcatcatatttattgcttttaaaatattcaatttcttctgtgttaaatattttctttaaaaaagcgtctttatagggtctttttaatatttttcttattctatcaacttttactatatcaacaccatttgatattatttctttgtctatcatacataattcctttaactgcaaaaagacctctctaagatgaaaggtcttaaatagtctatatataatactaacctaaagcattgactttttttgctaattgagctttttttctgtttgcagcatttttatgaataatacctttgcttgcagccatgtcaaattttttgcttgctaatttgcatgcttcattagctttttcaacatcattagataaaatagctttttcaaaatctttttcaactgtttttaagttagttttgatagctttatttctaagtctgcttttttcgtttgtaattgctcttttctttgcagatttaatgtttgccacttgctacacctccactttaaatagtctcgcgaatgatattatagcacctatatataccaaatgcaagcatttttttactttcttttcatgttttcttattgtttatattttacatagcaggttgttcttttgctattaaaattttaccttttttcttacctgtttcaactactttatttgtattaaatactttttgatattccataagacctttatctaaaatgttaactgcatttattaagtcttcttcttttaatacatacgcaattcttacttcatttactccaagttcttttgttgaataaaattcgcttgcagggcaaagcataactgtttcgttgttataatcataattttcaagtaaccattttgagaattcatgagcattttcaacaggaagttttgctattaaataaaatgcgcctgcaggtttttgtacttggataccttttattttctttaatctttgatatattgtatctcttctatgtttatattcttttattacactttctatgtattctttgcttgtatgttttaaaacagcagcagctccgacttggtcgatataaggagcacaaagtcttgcttgtgcaagttttaaaacgtgagccataaattcttcattttttgaagcgattagacctattcttgctccgcatgcagaaaatctttttgaaatgctgtctattattacaactttgtcttcaacgtcttttatagatgaaaaacttataaatttaccgtcgtaaacaaattctctgtaaacttcatcaactattataaataaattattttcctttgcgatgtcacataataattttatttcttcttttgtataaactcttcctgttgggtttgaaggatttgttatgcaaaatgctcttgttctatctgttatttttgattttatttcttttttgcttggaagtctgaagttttcttcaggtcttgttgttatggaaaccatgtttattccagcttgagtagcaaaaatattgtagtttgtataataaggttcaaaaacgattatttcatctccttcattacaaagagttaggaaagaaaataatatagcttcgcttcctccgtttgtaactatcatgtcttcttttttcatatttgaaccaatttctttgtaatattcttcaaatgcttccaatagttcaggaataccttttgagtttgtatatgataatatgttttcatcaaagtttcttaccgcgctaaaaaattcctttggtgtaactatatcaggttgcccaatatttaattgatatacatgagttccttcttttgttcttttttcttgtattggggcaaattctcttattggagattgtcctattgatgtaactttatttgaaaacataactttctcctttattttattatcttactataagatatactatcataaaataaagtatatttcaagtattaattttataagtaaggtatttttttatttgtacattattataatatgtaaaaacaggaaaatggttaattaaattatgtattatttattgtaaatgttttctatcttaaaaaaattaagtatttactcaaaaaaaaattatttttataagttattgaaataaaataatttcatgatataatgttagcagttactaacattattttgtttgtattttttttatttttggtataaaatagatatatttaataatagaaagaagggtttttatgacaaaagtaaatataatatccggatttttaggagccggtaaaactacatttataaaaaaattggtaagtgaagtgtttacggatgaaaaagtaattttaatagaaaatgaatttggagaaattggaattgattcaggctttttaaaagatgccggaattgaaataaaggaaatgaattcaggatgtatttgttgttctttggtaggagactttagtaaatctcttgaagaagtaataaacacatattctcctgacagaattattattgaaccttcaggggtaggtaaactttcagatgttgaaaaggcaattatagatgtaaaagataaacttgatctttctgtagacagtaaaataaccgttgttgacggaaagaaagcaaaaatttatatgaagaattttggagaattctttaataatcaagttgaaaatgcaaatgttattgttttaagcagaactcaacttatgaaagaagaaaagataaatgaatgttttgaagaattaaagaaacataatgataaagcaaatattattacaactccttgggatgatttaaataaaggagtaatacttgatgcatttacaaattttgataaagaaaataaaatgcttgaagaattaaaaagagaagaaatggaaagtcatgaacaccatcaccaccacgaacactgtgaatgtggacatgatcatgaacaccatcaccaccacgaacactgtgaatgcggacatgatcatgaacaccatcaccaccacgaacactgtgaatgtggacatgaccatgaacaccatcaccaccatgaacattgtgaatgtggacacgatcatgaacatcatcaccaccacgaacactgtgaatgcggacatgaccatgaacaccatcatcatgaacattgtggatgtggacatgatcaccatggacatgatgcagatgaagtttttgaaagctttggaatggaaacaattcataagtttacaaaagatcagttaaatgatattttggaagacttagcagaaggaagtagttatggggttattttaagagctaaaggtgttgtaagcggagaagatgaaagctggtatgaatttgatttagttcctggtgaatacgaaattagagaaagaaatgctgattatataggtaaagtttgtgtaattggttcaaacttgcttaaagataaattagaaaaaatatttaaataacagaggtgatattatggtaacaccggtttttgttatatcaggtttattagatagcggtaaaacaactttaataaagaatatgtttagaagtcctgattttagaaataacggacctactcttcttattatgtgtgaagatggggaagaagagtttgaaagagattttttaagtgaatgtcaaataacaaaggtaacaattgatgatatagagaagttcactccaacacttcttcaaaattatgaagcattatatagaccaaatcaggttgttatggaatacaatgggacatggagtatggatacgcttcttaaaacagattttcctgaaaattggcagattgcaagcgtatattctttggttaactgtgaaacagcagaaatatatatgcttaacatgagagcaatgtttatggagcctcttaatttatcaagtctaataatatgtaacagatatgaagatgatatggacagagctaaacttagaagaaatattaaagctttaaatccaacagttcaaattgtatttgaaagaagcgacggaagcgttgttgaagaaactgaagaggatttgccttttgatataaatgcagatattatagatgtaagtgatgtggattatggtgtatggtttattgatacacttgataatccgggacattatatgggcaaaaaggtaaggtttaaagctcaggtttatactgataagagtttaggtagaaatacgtttgttcctgggagatttgcaatgacttgctgcgctgatgatatacaatttttgggacatgaatgtaagtattttttgaaaaacttcagttataaaaatagagactgggttgaggtacttgtgcatgttgagtatgaatttaacgttgaatacggcgaagatgttcctgtgttatatcttgaaagtataaaaaaagcagctaaacctgaagatgagattgtatattttatgtagtattagaagatatatgttttcatatatcttcttttttatttcttaaaaattgttaaataaaagttaaaaatattgtgttatttgtcaaatacatatataatttaagtatgctaaaaggagaggatgtatggaaaaaagaaaaagagtcgtaaaagtaaaaaaaacgatgagaagacctaaaagaaaaaaaataaacaaagataataatataaatcttatggataataatctttttgaagatgaaaaagtactttctaacatctcagttgatgaaggaacaaaagaaaatattgatatcaaagatgatgtgctttttgaagatgtagatgtaaaaacagaggatttttctaatataaaagaaaatcaatttgatgatgtaaaacaaagtaaaaaagatgttgttttaaataacaaaaatagcaaaactaagaaaaataataaaaaagcaagcaagaagaaatatatacttggaggaataggggcatttgttttaatatgtgttgtagctattattgtaagttataacgttttattaggcgctgttgattcttcaaatacaaataaaatggatgttacaatagaagaaggttcatctctttcaggtatttctcagacacttaaagataaagatttaataagaagtgaacttgcatttaaagtgtatgttaaattaacaggaaaatcaaatgatttaaaggccggatattattctttctctcaaagtcaatcagcaggagatattgtttctatcatgatggaaggcagtaatagcgatacagcaactgttacaataaaagaaggtcttgaccttaacagaattggtgatactttagaagagcaaggaatatttacaaaagaagaatttttaagtgaaattaaaaataatgcggattattacagagaaaaatatgatttcttatcaagtgttccaaaggatagagaatatattttggaaggatacttatttgcggatacatataatatttatgtaaattctacaccaagagatttaatagaaaaaatgcttgatagattcgatcaagaatatacagacgaatataagaaaagaacaaaagaaatgggcaaaaccattgatgaaattgtaactatggcatcggttgttgaaagagaaacaatacttgattctgaacttccgactgttgccggggtattttataacagacttgaaaaaggtatgatgcttcagtcttgtgcaacgctacaatatatttataaggattatcaattctcttttacagaatcacaaaagaatattgattctccatataatacatataaatatgaagggcttcctgcaggacctatatcaaactttagagcagcttctctaaaagctgcactttatcctgaagataccgattatttgtatttctgtacaaaaaatgacggtacgggagcaagtgcttttgctaagacttatgaagagcatgaagccaatatacaaaaatatagtgggaactgggaataaaaaatgataaatgaaataacaaaggaatatttagagggtcttcttcacttaagtagtgaagaagatgctcttttagagtttagaaaagaagcaaaaggaaataatatacctattattacggaagatgttgaaaggcttgtaaaaattattttaaagtcaagttcttcaaagtctctttttgaagtaggaagcgctgtaggttattcttcctgtgtgtttgcagatacaatgggtaaagatagttatgtaaaaactatagaaagagatgaaataagatatatcgaagcaaaaaataatataaagaaatacggttttgaagataatattgatttatgtcttgatgatgcaggggaagtattaaaaaatgaagaaaaggtatatgatgttgttttccttgacggaaataaaggtcattatatccatatgcttgaagactgcaaaagaatactaaaacccggtgggcttttaatatgtgataatgttttatttagaggaatgattgataaaagtaagcctctaattagaagaaaaataaccattgtaaaaaggcttagaaagttcttagatgctataagtgaagatagtgaattaactacttctgttcttcctataggggatggtttaagtataagtataaaaaaataaggaatttgttaaaattttaatagtattttgataaatttatgttataatctaattaataccgataaaagaaaaaaaattaggaggaattatatatgtattcaaaaaatgtaacaattacaaatcctacaggtcttcatgctagaccagcatctcaatttgtacaaacagctgctaaattctcatcagaaattcttttagttaagaatggaaatgaaatcaatgcaaaatctatcatgggcgttatggctggtggattatctcaaggtacagaattagaaatcagagctaacggtgctgatgaacaagaagctgtagatacattagcagctttaatcgaagacggttttggtgaataatttacttatataaaaaaaagacatatcttttgatatgtcttttttattttaaattttatttccaaacttctttagctatttcttttattaattttaatttttcccattgattttcttctgttaagatatttccttcttcggttgaagcaaatccgcactgtggacttaggcaaagattttctaaatctatatattttgttgcttcttttattcttttctttattatttctttatcttccaaaattccgttttttgatgttataagaccaagaacaacaaacttatcttttggtacaaatcttaaaggttcaaatcctcctgaacgttcatcatcaaattcaagataaaatgcttttacattttcttctttaaatagaatttctgcaataggttcatagcctccttcgcttgcatatgttgagtgataattgcctctgcatacatgagtagtaactattaaatcttttggtaaatttgctatagctttgttgtttaattctacatataattttgcagtttgttttacttcttcttcacttagtccaattaattttatagcttttttgtcgcaaagcattccccatgtacagtcatcaagttgaatatttctgcatccaagttcataaaatttcaaaattgttttattataagcgcttgcaatatctttaattaatttgtttgtgtcattatagtatttttttacctctgatgcattatccggtctttgtaattctgcgaaaaactgtgctggagcaggtatggtttgtcttggaattacatcgttatttaaagctattttatgtaaaaatttataaccttcaaagaaaggatggttttcattatattctactttgccttctaaagatactgtttcagctcttgtttcttcatctttaaattgatatcctttttcaagttctttcttttttactcccttaagcccccacatgaaatccaaatgccaccaacttcttgtaaattctccgtctgtaactgattttaatccagcttctttttctttttttacaagttcttcaatacatttgttttggattttagttaattcatctaaattaatttttccttttatataatcttccttagcatttttaagttctaaaggacgtaggaaacttcctacgatatcatttctaaatggtacgtttgttctttttgtcataattaattcctccttaagttgctttgttagtatatcatgtttttttattatgtgataatatacattttttatattttgatatagaaaaaaggaatatcaatattgatattcctttatataatcttctaatttttcaatgtatttctttgccggtatgctaaggcttgcatttttgtgttttatataaccaagtcttatgacttcatcagattcaagaggaattgaaacaaggttgcttccgttaagttcaacacttaaaatacccgttgttatggtatatccctgaagacctataagaaggtttgaaagagttgctctgtcacttactaaaagatttttcttatgagaaagtgtacttaaaatttcttccgagaaataaaaagaattatatgtaccttgttcaaaggaaactcttggatatggatcaaggtcttctatagtaagtttttctttttttgcaaggggattatctatgcttataaaaatatgaggtcttgcatcgaaaaggtgagtaaaaactaagccgttatcttttaaaattttatttattactttttcgttaaaatcgtttaaataaattactccaatttcgcttctaagattttttacatcctctattatttcatgggttttgctttctcttatggcaaactcatattcgtctttatcaaattctttaaccatgtttacaaaggcgtgaacggaaaaagcataatgctgtgtggaaacagagaatattctttttgatggagttttattcatatatctttgctccaaaagttctgcttgttctataacttgtcttgcgtatcccaaaaattcggcaccatctgaggacagagatatacctctgtttgaacggacaaatatttcaatgccaagttcgttttcaagttcttttacggattttgaaagacttggttgagttatgaataatctgcttgcagcttcgtttatagaaccacagtttactatttctattatgtatttaagttgttgtaatgtcattttgttttacctaaattttacattcctttaatttttctttaattagtatgcaatatattatatcatacaaaaatataatatacatataaattgttttagaaagtaaaagaggggatttatgcaagaaacactgttaagttttattagagattacggatatattgggataatgattttaatacttgttgaaaatatttttccaccgattccttctgaggttgttttgttgtttgggggatatatggtagttgcagcagggttaaacccgattgttgtaattatttttgcaacgataggtgcaattcttggtgcggttatactttatatactcgggtatatgtttaaaagggaaaaacttagagatttgttttccagtagattaggaaaaattttacatttaaaacctgaatatattgatttaagttataattggtttttaaaatttgaaaataaggctgtgtttatatgcagatgtatacctgtagcaaggagtcttatatcaattcctgcgggactttccagaatggaattttcttattttattatattaagtacacttggtacattgatatggaatactttacttgtttttcttggtgttattcttggagatgcatgggaaagttttcttccttattttaaaagctattcaaacatagtttggatattgatttttgctttcattattatttatattttaagatacaaaaaaggtaaaaaatagccgatatataggcaaatcttgacaaaaaaataaacttaatataaaatattacaaaggtactattttcataggacctttgtttttttataattaaaaagataggagaaattgtaatggaggcaaaccaaataggaatgcttgcggtcatatttatttatttaataggtatggttgttattggagcatttttatcaaaacaaaacgagacggctcacgatttttatttaggaggaagaaaacttggtccttttgtaacggctatgagtgccgaggcctctgatatgagtagctggttacttatgggactacctggagttgcttatttatcaggtatagccgatgcaggatggacagctttaggtcttgcaataggtacatatgtaaactggcttattatagcaaaaagaataagattatatacggaagtttcaaagaactcttttactcttcctgatttcttttcaaataggtttagagataaaaagaagattttaatgcttatatcttcattatttataattattttctttattccttatactgcttcaggattcgctgcttgtggtaaattattctcaagtttatttggtattgattattttaccgcaatggttgtaagtgcagtggttattattttatatacagcaatgggaggtttccttgctgcaagcactacagactttattcaaagtataattatgtctgttgctcttgttattattcttgtttttggaataactgctgcaggcggtatggatatggtaataagtaatgcaaaagaacttccgggatatttgagtatggtttcaactcataatatgacaacgggaagtgctgaaagttacggatttttaacaatcgtttcaaaaatggcttgggggcttggttattttggaatgcctcatatattacttcgttttatggctattgaagataaagacaaacttaaaatttcaagaagagttgcttctatatgggttgtaatttctatgtttgcttctattttgataggtataattggttatggaatgacaaaagcatctgttattccattccttgaaggaacatcttctgaaacagtaatagttcaaattgcaaatgtattaagtacacacggatggatatttgcttgctttgcaggtgtaatacttgcaggtattcttgcatcaacaatgtcaactgcggattcacagcttcttgctgcttcttcaagtgtatctgaaaatatcataggtggtgtttttggtaaaaaccttgacggcaaaatgagaatggttgtagcaagaggatgtcttattgcaattgctgttcttggtattttccttgcaaaagatccaaacagctcagtattctctattgtatcatttgcatgggcaggttttggtgctgtatttggaccagttgtattatttgctcttttctggagaagagctaataaatacggtgcaattgcttcaatgatttccggtggagttatggtattcttatggaaatacgttataagtaatttaggtggtttatttgatatttatgaattattacctgctttcttaacaggttgtatatttatggttgtggtaagtcttcttactcctgaacctgaaaaagaaataactgatgaatatgataaagtacaaagtttattataatttttcttaaaagcggagttatccgcttttttatttttgtttaaataatttatatattcttaaggttgagttaaataaaaatatattatataatttttatatattttaggaacgaaaggtgataaagatgaaatgtccacattgcggttttagcgaaagtaaagttatagattcaagacctactgatgataatacggctataagaaggagaagagagtgtttatcttgtgcaaaaagatttacaacttatgaaaaaatagaaacgatacctttaattgtagttaagaaaaatggtactagagaagcttttgacagaaataaacttatgaacggtataataaaatcatgtgaaaaaagacctgtttctattgagcagatagaacatgttgtaaatgaaatagaaagtaatattcaaaaaatagcaaagaaagaaataccatcaaatttaataggtgaagagataatgaagtacctaaaagatttagatgaagtttcttatgtaagatttgcttctgtttatagacagtttaaagatgtaaatagctttatggatgaacttaaaagtatgttaaatgaaagagatggtagaggtaacaaataatggatattacagaaaaaatagataaaacagaagttctttttaaaggaaacatttttgaagtaaggagagattatgttactcttccaaatggggaaaaagcaacaagggatgatttgaaccatgcagactcttctgctgttttagcaataacagaggacaataaggttgttcttgttaagcagtatagatgttctgtttatggtattaccgttgaactcccaacgggtaaattagaaaaaggtgaagatcctatggaatgtgcaataagagagcttgaggaggaaacaggatataaggcagaaagtcttgaattctatatgaatagttggcctgctgtgggatactgtaatgaagttatacatatatatttagcaaaaggcctaaaaaaaactaaacaaaaattagatgaagatgaatttataaatgtttttgaagttgatataaaagagtttaaagaagatatattaaataataaaaatattgattctaaaactgttagtgcagttttaaaatattgtattgaaaataatatataaacagtcataaaatataaataaggacataccctttattaatagggcatgtcttttttatgtcacaaaaaataaggaataatattttatggttagagaatttataaattatcattttaaggaaaacaaaaataaatatttattttttcttattgtttttcttcttgggattataatagggggagtcagtatatattttttaagttctacacaattggatgagcttaaagattacataggttcattttttgaactcattacaaaagatacatcaagtatagatagtaaaaagatttaataaaaggattcgatttaatcacatttaacagtattatggttgagttttttcttttggttatattttttagaggtattaattttaatggtaataatccaaagaaaatactatatccatgtatggtaatcattactgttgtatgtgtattttttgttttaagggcattttattatattgtgattggaaatagcttatttgatgcacttttaaaatcccttacttttaatatatcaggaagtgtttttgatgttaatccgaatgatccgggtatactagttatgtttgtatgtgcctttttactttcttttgtagagaaaaagaatatatatatatatttatttttaacatcacttgttgcatatttacttctttgtggatgtagaagtgcatgtgttggaataattgctgttttaatatctatgtttatttataaaaaatataaaaatattaattgcaataaaataatgctttcaatgctgatattttcatttatatatttaatgagcttgtttacctgcactatgataaataaggacacaattgtttttacaccttttgaaaaaagctggaatcattatagctcaacaaggtatatgcttgataagtatactatcttatctttggaagatgattttcttcttgggtttggttcttttaaatatacgggagaaaaaagatatgaatatttaatggaacattttcctcaagttgttgatgttagactcggagcagatgcaaactatgcaaataaatataaaagtttaaatgctcataatggatttttagattttattgccggaaatggtataatatgtttagcattgtttttatattttattataagtaaaataaaaaatatagatgataaagtgtgcagaaaatattacttaccgattatttttatgattgttgtttcaaattttgaaaatacaattttaaatataattccatttatgtttttcttgatacttttatttatatcatgtatggaacatgataatttgaatcttgataaatcaacttaaaaggaaaattttaagtgtagaaaataaaaaattaaaatatataatatttttaataggagttaaaaatgggaaataatgaaagaatttttttagcatctcctcatatgagtgatgaaggatatgaacaagaatacattaaagaggcttttgatacaaactggatagctcctcttggtgcaaatgtaaataactttgaaaaagaaatatgtgattacacaggtgcaaaagatgcagctgctttagttagcggaacatctgcaattcatcttgcaattaaacttttaaacattggtaaagatgatattgtattttgtcaaagtcttactttctcagcaagtgctaatccaataatttatgaaaatgcaacacctgtttttatagacagtgattttgaaacatggaatatgagtccaaaagcactaagggaagcttttgaaaaatataaagaacaaggaataaaaccaaaagctgttatagttgttcatctttatggtatttgtgctaatttagatgaaatagtatcaatttgtaaagaatatgatgtgcctttggttgaagatgctgctgaaagtttaggaagtatttataaaggtcaaatgacaggaacttttggtgattatggaatactttcttttaacggaaataaaatcataacatcttcaggtggaggtatgcttcttgtaaatactcctgatagcagtgaaaaagcagcaagagcaagatttttatcgacacaagcaagagaaaataaaagatattattatcataaagaagcaggatataactacagaatgagtaatattgttgccggtattggaagaggtcagcttaaggtattagataaaagagttgaacaaaaaagagaaatatatttccattataaagatgctttcaaagatattaaagaaataaaaatgatgcctattgatgacgaaaatacaagatgtaactgctggttatcttcaatacttattgatgaaaaatcaaaagttaaacctcttgatattattttaaaattggaagaaaacaatatagaagcaagacatatttggaatccaatgcataaacaaccattctttgaaaaatatgattatattgataacggaggagtaggagagtatatctttaataacggtgtatgtcttccatctgatacaaaaatgacgaaagaagatatgcaaagagtaagcgacataataaagactctttttgaataattatgattagaaaaagaaccttttacgacaagtacataaaaagaattatagattttttactttctttaatcgggataattattttaagtcctgttttattgattgtttctattatggtaagaacaaaattaggttctcctattttatttaaacaggaaagacctgggttaaatggtaaaatttttaaaatgtataaatttagaactatgacaaatgagactgatgaaaacggagagcttcttcctgatgaagttaggcttacaaaattcggtcaattccttagatcatcaagtcttgatgaacttccggaaatgtttaatatattaaaaggtgatatgagtattgtaggtccaagacctcttttagtaaaatatcttcctttatatagtgaaagacaatctcacagacatgatgtaagaccggggcttacaggttatgcacaggttaatggcagaaatgcgataagctgggaagaaaagtttgaacttgatatattttatgtaaacaattcttcttttatggtggatttaatgatattctttaaaaccattaaaaaggtttttgacagagaaggaataagcagtgatacttctgtaacaatggaagaatttaaaggttcaagagaagctgaagaggttgtataatgaataaagttgttgtaataggcggcggtggacatgctaaggttgttattgacattataaagaaaaacggttataaagatgatgaaatagctgttttagatgataatttgaatataggaacaaaaattctaaatgtagaagtaaggggaaaagttaaagattgtattcaatttcccaaagatacaaagtttattattgcaattggaaataataaagtaagagaaaaaatagcaaatgaatataaatttaactatacatcatttattcatcccaaaagtataatcgctgaagatgtaaagataggtgatggttgtgtagtaatggcaggagcagtaataaacagtggtagtgtaatatcagatcatgttattgttaatacatcagtttcaatagaccatgacagcaaaattgatgattttgctcatctttctcccggagttcatatgggaggaactgttaaaataggtaaaagaagctggattggtgtaggaagcagtgtaaaaaacaatattacaatatgcgaagatgttactgttggtgtaggcagtgtcgtagttaaagatataaaagaaaaaggtgtttatatcggctgtcctactaaaaaattaaacaagtgtatggagtaataaatgaagatttggattttaaaccattatgctacaaatatgtattttgacggacttggcagacatcaaagttttgcaaaatacttaataaaaaaaggacatgaagtaaaaatattttgtgccagtacggttcataacagcgatgaagttgttgatcttggtggcagacaatatattgaaaaaaaaggtatggataatgttccttacatttttgtagatacatctatatataaaggtaacggtgtttcaagaataaaaaatatgtattcttattacaaaaatgtaaaaaaagttgtaagtgaatatatacaaaaagaaggaaaacctgatgtaatatatgcttcgtctgttcatcctcttgcacttgttgctggaataaaattaaagaaaaaatttaatataccatgtataaatgaaataagagatctttggcccgaaagtcttatagaatatggtataataaatagaaatagttttattgcaaagattctttataaaggtgaaaaatggatttataaaaaatctgatgcagtactttttacaattcccggtggagaaaaatatattgttgacagaaactggatattagatattccgttaagtaaaatattttatataaataacggcgttgatcttgaagaatttgaatataataaacaaacttatcagttagatgatgaggatttagaaaatgatcaaatatttaaaatcgtatatgcaggttcaatcagagatgtaaacaatgttgatgaaatattgtcaatggcagatatctataaagaaaagggaataaacaatattaaatttataatttacggagacggtccaagaaaagaaccgcttgaaaatttagctttaaaattaagacttgacaatgttgtatttaaaggaagagtagaaaagaaatatattccatttattctttcaaaaagtaatcttaatttaataagcggtatttccggtaatataggtgcttatggcgtaagttggaataaactttttgaatacatggcaagcggtaaacctatatgtgcaaattataatcttggagattttaatttaatagaggataataaagtaggaatttgtaagaagtatactgatttaaaacagtactgtgacgatatagaaaaaattgttttagataatgaaaattataatgaactttgtgaaaatgcgaaaaacgcaagcattgagtttagttttgataaattaaccgataaattaattgatgtgataaattatattattaagtaaagtagggtgaaacgtatgaaaaatgaacttttaaagaaaattgaaaacaaagaaatagttgtaggtgttgtaggtcttggatatgtaggtcttcctcttgcagttgaaaaggcaaaagcaggatataaaacaataggttttgacgttcaagcaagcaaagtacaaatggtaaatgaagcaaaaaactatattggagatgttgttgacagcgatttaaaagagcttgttgaatctaagatgttatctgcaacaactgattttagttttgtaaaagatgttgattttattgcgatttgtgttccaacacctcttgataaacatcaacaacctgatatttcttatgtaaagaattcaagcatagaaatagcaaaatatttaacaaaaggtacaatggttgtattggaatcaacaacttatcctggtacaacagaagagcttattaaaccaattttggaagaaggttccggattaaaatgcggagaagatttttatttaggtttctctcctgaaagagttgacccaggtaacttaatatataaaacaaagaatacacctaaagttgttggagcaataggtgaagatgcaacagaagtaattgcaaaaatgtatagttcagttttagaaggtgatatttatacagtttcatctcctgctgttgcagaaatggaaaagattcttgaaaacacatatagaaacattaatatcggtttggtaaacgaacttgcaatgctttgtcatgaaatgggaataagcttatgggaagtagttgatgctgcaaaaacaaaaccatatggtttccaagctttttatccaggtccaggtcttggtggacattgtattcctcttgatccatattatttatcatggaaagcaagagaatatggttttcatacatcaatgattgaaagttcaatgatgattaatgataaaatgcctgaatactgtgtagaaagagcaatgaaaatattaaataaacatggaaaagctttaagcaaatcaaatgtacttgttcttggggttgcttataaacaagatattgacgattacagagaatctccggcaatagatgtaattgaaatacttgaacaaaacggtgctaatactgagttttatgatccatatataagtgaatacaaacacgaaggaaaagtaaaaaaaggtattgaaaaaattgacggagaaattatttcttcatatgatttaatagtaataactgcatctcatagcaatgttgattatgaaatggtaagtaaaaatgctaaggcaatttttgatacaaaaaatgccatgaaagaaattgaaaacagagataatattgaagttttataattaggagaatgaaaatgaaatatgcattaattggttgtggaagaatatcaacaaatcatataaaagcagccgtaaacaataaattggaaattgtcgctgtttgcgatattttagatgaaagaatggaagagcttctttctaaacatgatttacaaaatgatgaaagtataaaaagatacaatgattataaggttatggttgaagaagttaaacctgagcttgttagtattgcaacagaaagtggttctcatgctgaaatagctttatatttaatagataaaggaataaacgtaataattgaaaaacctatggcgatgagcattaaagatgctgatgaaataataaaaagatcagaagaaaaaggtgtaaaagtatctgcttgtcatcaaaacagatttaatattgcagttcaagaaatgagaaaggctcttgaaagcggaagattcggtaaactttctcatggttcaattcatgttagatggaacagaaataaaaattattatgaacaagcactatggagaggaacatggaaagaagacggcggagccttaatgaatcaatgtattcatggaattgacttgcttagatggatgatgggagatgaaatcgaagaagtttacggagttacaaaacaacaatttcatgactatcttgaagccgaagatgttggaatggctgtagtgaaatttaaaaatggtgcagttggaacaatagaaggaacaacaaatgtatatcctaaaaatcttgaagaaactttatatttattcggagaaaaaggaactgttaaacttggcggaaaatctacaaacaatattgatgtttgggattttgcagatgaaacagatgaagacaataaaaataaaggtcttgaagaacaaacaagtaatgtttacggaaacgggcatacatctttattcagagatgttatagaagcaattgaacaagacagaaaaccttatgttgatgcagttgcaggaagaaatgctcttgaacttgttttaagtatatataaatcacaaaaagaaggtaaagccgtaaaacttcctttagatgattttgcaagtactgatatgaaaggtgaattttaatgagtgaatatttcgttcatgaatccagctatatagatgaagatgtcataattggtaaaaataccaagatatggcatttttgtcatattcaaaagggtgcaagaataggtgataactgttctttcggtcaaaatgttaatgtatcaaataacgtaaaaataggtaatggttgtaaagttcaaaacaatgtatcaatatacgaaggtgtagaacttaaagattatgttttttgcggcccttcaatggtttttacaaatgatttaacaccaagagcaaaatatccaaaaggaccgagtggttataaaaaaacattacttgacacaggctgtagtataggtgcaaatgcgacaatcgtttgtggaaataaaatcggtaaatgggcaatgattgcatccggtgctgttgtaacaaaagatgtgccagatcatgctctttatgcaggtgttcctgcaagacaaattggatatgtatgcgaatgtggaaatgtactaaatgaagatttgaaatgcagttgtggaagagagtatagaaaagaaagtaatggtcttgtaaggagtaataatgattaaggtttgtcatatgaccagcgcacataaacctaatgatattagaatttttgaaaaagaatgtgtttctttggcaaaaaaagaagaatacgatgtgtatctggttgcaaaaggtgaaagttatcaaagtaaaaatgtaaatattgtaggaataggtgaaataaatagaggcagaatatcaagaatgctttttacagctaaggatatttataaaaaagctcttgaagtagatgctgatatatatcattttcatgaccctgagcttcttccttacggtttgaaattaaagaaaaaaggtaagaaggtaatttttgacagtcatgaaaattacagtgaacaaataaaggaaaagtattatattccaaagattttaagaggatttatttcaaaagtatttaaaagttatgaaagcaaagtaacgaaaaaaatagatgctgtcatctttccttgtccaatgtttggaaagcatccttttgagggtagaagtaaaagatgtgtatatataaataatactcctatacttgaagaattatatgataaatataatgaaaaagataaagattattctaaacctgttgtatgttatgccggaggacttaatgtaaacagaggaataacaaaattaatagaaggtagctataaagccgatgctaaattaattcttggaggaaattttgttcctaactcatatggtgaagaattaaagcaaaaggaagaatataaatgtgtagactttagaggatatttaaatagagatgaagtattgaatatgtatgaagaatctacaattggcgcaaatgttcttttaaatattgggcagtattctgttctttcaaatttatctaccaagatatatgaatttatgtctatggggcttcctgttataagtaatgattatccatacgcaagagaagtaatggaagaatataaatttggtttggttgttgattcaagtaatagtgatgaaattgctaaagctataacttatttaagtaataatcccgatattgcaaaacaaatgggtgaaaacggaagaaaagcaattaaagaacattttaattggagtgtagatgaaaaagttttatatgatttatatttagatatattgaaatagtgaggatagatatggaatttagagatttaaaaactcaatacagagtattgaaagatgatatagacaaagcatgtgaagaagtaatgttaaactgcaattttataagtggaaaacaagttgaagaacttgaaaaagaacttgcagaatatgtaggtgttaaacattgtgtaacttgtgcaaatggtacagatgctctttctcttgctttaatgtcttggaatattggtaagggagatgctgtttttgttcctgattttactttctttgcttcaggtgaagtagtatcacatataggggccactcctatatttgtagatgtagataaagacagctttaatatttgtcctaaaaagcttgaaaaagctattttaaaaattaaggaagagggaaaactaactcctaaagttattgttgctgttgatttatttggacttcctgcagattataaagaaataagaaaaatagctgataaatatggtttatttattcttgaagacggagcacaaggctttggtggtgaacaagatggtaaaaaagcatgtagttttggggatataagtacaacttctttcttccctgcaaaacctcttggctgttacggagacggtggagctgtatttactaacgatgataacatttgtgaacttttaaaatcttatagagtacatggaaaaggttctatgaaatacgataacgtaagaattggtgttaattcaagattagacacaattcaggctgcaattttaaaaataaaacttagagcatttaaagattatgaattaaaagatgttaatgatgcctcaaaaaaatatacaaaagcattaaaagatattgttaaaactcctgtaattaaagatgggttttattcaagttatgctcagtacactcttactttggaaagtagagaaataagagaaggtcttcaagctttcttaaaagacaatggtattcctacgatgatatattatccaaaaccaatgcatgaacaaaaagcatttgattatttagattataaaggtgaagattttgaaaacacaaatatgctttgcgattgtgttttatcaattccaatgcatccttatttaaaagatgaagatattgattttgttgcagataaaatcaaagaatttttcagtggcaggaaataaatgaaaattttattaatagggaatgcaaattctttttggataaaagaatatgtacaatatgtacttttaaatgaggaaaatgatattttcatcgtatcaaaaccggtgacaaataaggaatttaagtatttttattcaaatagttctgttcaaattttaaatacagataagggaacatttttaattgactttatccccaaaatcagaactcttgtaaatatgagaaaaaaagtaaaaaaagagttcaaaagaggaatgtttgatgtgattcatattcattctgttccaagcaattttatgattaaattcttaagtaagaaaataataaaatatggtaagagcctaatttgcacatactggggatctgatttattatcaaaaagcaaggaacagttagaaaatgccataccttgccttgaaaaagctaagtacatatcttattcttctgatggaatggataaatatttccatgatgtatttggagatatttataatagtaaaattcaacgtgctaagtttggtatatcaatttatgatgttataaaccaagtaaaaaaagaaaaaacaaaagaagaatgtaaagaatttttagggataaataaaaataaaataagtgttgcaatagggtataatggtaacaaaagacaacatcacttagatgtaataaaagagattgcaaaattaaataaagaaacattggataaagtatgcttgatagttcaattaagttatgggctttcaagtgaggaatatcgacaagaaattttagatgaattaaataaaatagatgttgaatttgttgtaatagatgatttcttggataaattaaaatcagcaatgttaagacttgcaactgatatttttgttcatgcacaggaaagtgatgcattttctgcatcaatacaagaatgtgtatatggaggaagtattcttataaatccatcttggataatgtataaagaatttgataatgttggaatagattatttaacatataattcttataaacaaataggagaatatataaataatattattgaggggaaagttgatatagacaattctgataaagtcaatcttttatatgataaatattcatggcaagcagtaaaagaagattggttaaagttatatagttaatacattggagtaaagttatgaataaccttttaattaacgttattaataaaataagtaattggaatcaaagagtatcaaatgagaataaagctaaaatacttgtttttagctttttcttattatttgtcaatatgatgctttctacatcgggtgtatataaaggcagtacatcaatagcagcatttataggtgtagttattacttttgtaataatgtgcttaagtatacataaaatagataaaattgaatttaacaaagcagtaatgattttatactatatagttggactttgttttctaatgtcagcaattttgcataaagttgttgcttttgttttgcttgcattgatacttttgtttttatttcctgttttttacataatttttaatgcaaagaaaaactataatgaatttttaatcttactttcaaaaggggcaaagtatagttatattttaatgataattgtttcaattattatttctccattatcagatggacagtatgcatcttttttaggtaatccaaatggtctgggagcttttgtttctgtgatatttgcttctttgctttacttatatgaagtacaagaaggaaaaaagaataaaataataaatatgtttttaataggaagtatatttgcttttacaatattcactaaatcaagaacgacttatttatgtttgggattttcatttattgtatatttaatatatttgtttataaacaaaagatatacaataaaaaatataataatgaaaatattaaagatttttatttctgctgttttaggcacagtaataatatttgtttgtctaacatatgtaaatggatttattttaaaaatggaagaaaatatccttggctcatcctttaaggttgtgtttgatcctcatagcagttataacgaaattacagatttgggaagtcaaatttccagtgctgccgatagaggaaaaaaaggaataggaaacagcgattctttgtcttcaggaagagctgaaatatggagaacttatctaaatgatttaaatattacaggtcataatgcagataaacttaaagttttgtatcaaggtgggtatatagaagcaaatgcacataatacatatttgcaaatagcacatagcgcaggtataatagcaggaataagctttattgtcttaaatttaatgtttgcatactatctactcagaattctttttaagggaataaaagaaagatatttagatgaaaaatatttatttttaggtggtatgttaataagctgtgagataacaatggttttatcgtcagtatattatccatatataagtgcagtttcgttgttttattattttataatagggtatttgtttaacaaaaagaaatatttagatatttaattgaaataatgtataaagtaaattggagagtaatatgagtcaaaaaatatcttcagggaatgttgtgataaatctaatatggaagtttatggagcgtatcagtgtacaagccattaatttaattattcaaattcttctttcaagaaaactttttccggaagattttgcggcagtggctattattactgtatttataaacattgctacaatatttgttcaaagcggttttggaacggctttaattcaaaaagcggaaatagatgaaattgacagttcttctatattttattttagcatcaccgcttcaatagtattatatgttgtgttatattttatttcaccccttgtttctgcttattataatattgaaattttaaaatatcttcttagagcggaaggaataatacttgtatttggggcattcaatacagtacaacaggcaattatggcaagaaatcttgaatttagaaaaaacttcagagcaagtttacttggttgtatttctgccgggatttcaggcgtagctcttgcatatgcgggagcggggatttgggcccttgcaatatcaacaatagttaataattttgttttgacggttgtattgtggtttagcgtaaaatggagaccaaagctcgttttttctgcaaaaagagtaaaaacattattttcatttagctggaaacttgtttgttcatctcttgtaagcaccttttatacaaatatcagaaccttaataataggtaaggcttttaatcaaaaaacacttgggtattacaataggggggacatgcttggttcaagtcttatgaacggacttacaggtgcaatttcatcagtaatgttgcctgttctttcaacaaagcaggatagggtagatgaacttaagaaaatgcttagaagaacaatgtctataaactgttttgttatttttcctgttatgtttggtcttgttgctgtttctaaacctttaatagtaattttatttacgggaaaatggcttcctgctgttcctttcatgaggatagtttgtatagcctatgctttttatccaatgcattctgcaaatctacaagctattaacgcaataggaagaagtgatgtttctttaaagcttgaagttataaagagagttatggggctatgtttaataggacttagtttcccgtttggtgtttatgcaattgttggaagtgaaatagtattttcattgcttgcaacagttgtaaacggatttccgaataaaaaacttattaactattcaataaaagaacaatggagagatattttcccatatttattggtgtcaatagtaatgtgcgttattgtatatggtataagtcttgttttaagcgtaaataatattattttgttattaattcaaatattatccggtatatgtatttatgttttaggatgccatttattaaaacttgaagcatatgcatatatggttggtaaaataaagggatttataagaaaaagaaaataaagcaaggatttatttttccttgctttttttattttttcctgtatgctcatattctttaattaattcaagcagtttatttctcgcatctttaagagatcctacttcatcaataagtccaattttaactgcgtcttcacccactaaaacagaacccatatcgtttaccagctcatctgtatttaacattatttttgtaaaaacatctttatctacatttgaatgttctattacaaagtctgttattctttcctgcattttctggaaatataagaaactttgcaaaactcctattacaagccctgttgttcttatagggtgtatcatcatggttgcagaaggtgtaataaaagaatagttaccgcttacggctaatgggacaccaatgctgtgacttcctccaagcaccaatgttacgcaaggtttactcattccggagattaattctgatattgcaagccccgcttctacatctcctcccattgtatttaaaataagaagaactccttttatttcttctttttcttcaacatccataatcatcggaataatatgttcgtattttgttgatttttttggagaagaagcttcaacatgcccttcaatttctccgattatcgttatagtttgaattccgcttgaataaaagtcatttgtttgtccaagctcttttaacttgtttatggtttcctcatcaaaattttcttcatgagacatatcaaactctatttcattatttatttttttcattttctatcctttcaaaagtaataaaataagaaggaactttgttctgttttattttgtctgttaatgaaaaaaatatgtgttatattttgcataaaataaaaaaagaacgggtaaccgttctttttttactatttaataaggtttgtatgtaatacgttaaccgcatcttttgcttgttttgtatcaacaagtactgatactgttgtacttgagtcagaagattgatgaacaaaaatattgtttgagtataaagctgcaattatttttgcaacaactcccggaacacctttcattcttcccataattgttatttttgtaaatccttctgttattgtatattcaagacctaattttgtcattactctatcaactatatgttgtttatctgtatcaattataaatgtttttctgtcagggaaaatatttatcatatcaatagaaacttcttgatctgcaagaacttcgaataatttatcttctttcttaatatctgtaaatttaatatcaacttggctacaaccatccattgaagtaactgcagagaaatgtttgtcactgaaaatatcttgtggagtatcttcgattcttgttccaccataatatcttcctttttgtgtatttaaaattgcaataggaacatctgctttcattgcatattctactgctcttgggtgaataacctttgcaccatattctgcaagttggaatacttcatcgtagtctactgtttcaattaattctgcattttcaacaactcttgggtctgctgtcattacaccgtcaacatctgtataaatttcaacaagttcagcatttaaagctgcaccaagcgctgttgctgtaatatcacttccgcctcttccaagagttaggatttgtccgtttttgctcattccttggaatcctgcaacaacaggaacgatatcttgatttagaagttctaataatctgcttgtatctatttttactatttttccatcaccataattttcgtttgtaacaataccagcttgtccacctgtaagagctcttgcgtttattccttttgctcttatttcttcacttacaacaactgttgtaataatttcaccgcagcttgcaagtaaatctttgtttcttaagttagcattttttgtatcgggaagtaaacttaaaagagaatctgtggcgtatggttcaggttttcttcccatagccgaaactacaataataggtttaagtccatcatcgattgcatcgatcatgttttttataatcatacttcttgattttgctgtatttacacttgttccaccatatttttgcacaataattttcatgttttaaacctctgtatacttaattttttatatctaccattattgtatccattccaatttttacaatgttttcccaagctattgcacggtattgtacttcacctgaaaagaaggttctgacctttccttgtggaattaatactgcttctattttaccttctttttcattaattttcaagtcgcaattgcctaaaacccccattttttcaccgttatttatatttacaattattctatcctttaaatcagacaaattcatatgtttcacctcttttaagtatatgaaaatatctatggaatattaatgaaactttatgtaaatatatagttttatgtatattatattttcttgaaattgtttgcatttgtatatataattaaattaagataaagtatgaaaggatgtgagggaaatgctagatgcagaacaaaaaaaattggtaaaaaaatactgcctttatccaagtctttcattaacatttttaattgtttgtttaacaattggaattctttggttaattttaaacatgcttggagatttggtttttaattctactacagtttatactataggtatttgggtgtatattggtattgtattggtttatttgatactttttgtttattgttttttatgtacaaagcttggaatgagaaaagaaaagtggactaaaattgtagagtatgcagatgttagattatcaaataaagattattcaaaaagtataagcgctcttttaggtgcaagaggagtttcaactttacttgatttatctgataatcagagtttaaaaaacgcttctgatgctttagatgttgcttctgccataggtagtgttgcaatggttgcttcaatgacaaatgaattaagttctaatgcaaaaacagtcgcaagagtttttgatgttgaaattcctaaagcaagaaaatacgttttatcaatagtatttattccgattattttgttggtagctacatatattcctcattttattttttccgcaaataatgcaaataatcaaactctgcttgcatcaaaatctgtatatgcattacaacgctcatttgaaacagattgcgtgaatgtaagaattgatgatcctcttgaaaaatataattctcatggatatgatgttgcgggatatttatatgattatgatgaagagtataattcaaatataaatgtaagtgtaaataatgaaggattaatagaagagataacttacagtattgatattgatataaataaaagcaaagaagaaaatttagaaaaagctaaattagatattttaaaattaaatgtaatgttaaatgatgcaaatgtaaaagcattgtttaatgaacttcttgaagagtatgaactacctaaagaattttgtgataaatttatggaaggttcatattacgaaaaaataaattatagcgttaatgaaaatgttgatatagattactttacagaaactagggaagattatgatgagtatagttcatcttatatttatttcacaatagaagcagctgaaaaataaaaagaaagcaatatgctttcttttttatattccgctgtggccgaatcctccagcccctctttttgtatcgtcaagtttttctacctcaacaaattctgcaatttcatgttttgcaatgatcatttgagctattttcattcccggagttattgtaaatggttcgttttttaatgttgtaagtattattcctatttctcctctgtaatcagaatcaatagtacctattccgtttactaaagttacaccatgttttaaactaagtccgcttcttgctcttatttgtgcctcgtatcccaaaggaagttttataaatattcctgtaggtataagtttaatttcccccatgtttaccgtaatatcttcatcaatatttgcatataagtctactcctgcgcttccacttgttgcatattccggtaggggatattttgatttatttattatttctattttaattttatccatttttttctccaaaaatttatataaattatagttttttgttaagtatatcatatataatatttaatgcctaattttttataaaaaaacttgatgaaaattgttttattaatgcatttaaaatgctttacaatgattttcatttatgatataatttttaagctatgtaccttaggcttagtttatggaatctccgactttaagctaggttataggcgaataaaattaatataaaggagacagataaatgtcaataacaaaagaaaaaaaacaagaagtaataagcaaatttcaaaaacatgataaggatacaggttctcctgaaatccaaatcgctattttaacaagcagaatcaatactttaaatgaacatttcaaaaagaatcctaaagatcatcattcaagaagaggtcttcttatgatggtaggtaaaagaagaagacttttagattatgttgctaaaaaagatattgaaaaatacagaaaattagttaaagaacttaacttaagaaaataatttagcattaaaaaggcggatttttttcgcctttttttatgatatgtggaggaaagattttaaatgaagaaagtgtttacaactgatttccttggcagagaattaagcgttgaagttggcgaacttgcccaaatggcaaatggcagtgtatttatttcttatggagatacacaagtacttgtaaatgcatgtatggctaaggaagcaaaagagggaatagattttttcccattaagtgtatattatgaagaaaaaatgtattctgtaggtaaaattcccggtggattcttaaaaagagaaggtaaagccagcgaaaaagcaactcttacttgcagacttatagatagacctcttagaccattatttgacaaaggatttagaaacgaagttcaagtagttgcaacagttatgggtgttgaacaagataattcacctgaaataacaagtattcttggtgcatctcttgctcttggaatttctgatattccttttgacggccctgtaggagctgttcaagttggattaatagatggtgaacttgtttataatccaacaagtgaacaaagagcaaaaagtgatttaaacttaactgtagcaggcacaagcgaagctgttttaatggttgaagctggtgcaaacgaagtaagcgaagaaactatgattgatgcaataatgggagctcatgaacatattaaagaaattattaagttccaagaagaaatcatcaaagaagtaggaaaagaaaaagctgatcttccttactacagaccaagtgaagaaattaaagaaaaaatttatgaagaagctaaaaaaggatttagagaagcttataatattcatgaaaaacaagcaagagaagacagagttgaagaagtaaaagcagaaatccttgataaatatttagaagagtatcctgataatgagcttgactttaatgaaatctttactaagattttaaaacaaatagtaagggatatgattactaacgaaggaatcagacctgacggtagaaaggttgatgaaataagaccaattacttgtgaagtaggaaaagtaagaagagctcatggctcaggccttttcacaagaggacaaactcaagttatgtctatggctactcttggtgctatcagtgatgaacaaattattgacggtatcggagaagaaacaagtaaaaaatatatgcaccactataatttcccatcatattcagttggggaaacaggtccaatgagaggtcctggaagaagagaaattggacatggtgctttagctgaaagagcattacttcctgtaattccttcacaagataaattcccatatacaataagagttgtatctgaagttcttgcttcaaacggctcaacatcacaagcaagtgtttgtggttctactctttcattaatggatgcaggtgttccaattaaagctcctgttgccggaattgctatgggacttataaaagaagaaagcaaagtgtctgttctttctgatattcaaggtgtagaagacttctacggagacatggactttaaagttgccggtacaagaaaaggtatcacagctattcaaatggatatcaaaatcaaaggtattgataaagctattttaactgaagctttagcaagagctaaaaaaggtagatatcacatattagataaaatgagtactgctattgaaactccaagagaagaagtaagcaaatatgctcctaaaattttaacacttaaaatagacgaagataaaatcaaagatgtaattggaccaagcggtaaaatgattaacaagatcatagatgcaactggtgttaaaattgatattcttgaagatggacaaacttatgtaggtgctgttgaattagatgcagctaaaaaagctgttcaaatgattgaagatattacaagagaagttcaagaaggcgatacttatgtaggtaaagtagtaagaattatggactttggtgcttttgttgaaattcctggtggaaaagaaggacttgttcatatttcaaaattagctcatgaaagagttaataaagtaacagatattcttaatgtaggtgatgaagttaatgttaaggttatcgaaatagataaacaaggaagaatcaatttatcaagaaaagcattacttccaaaacctaaaaaagaagaaaaaaagattgacgaaaataaaaacgaagataaaaaaacagaagaataaaaatttaaaagcggggtgttaacttcgcttttaaagcatataaatagatatataacggaggatattatgactacaattcaagccataattttaggtatagttcaagggcttacagagtttttacctgtaagtagttccggacatttggtaattttacaaaattttatgggaataggggaaggtagtttagaatttactattgtacttcatttagggactttgcttgctgttgttatagcatattatggatcaatatggaatatgtttaaagaattcttcttaatgcttgcagatattattacattgaaaggtccaatgcttgataaaagtaaatacagaagatacatagtatatattttatgtgcatcagttcctgctggtatagtaggtgtgttatttgaagattttataagtgaaaaatttggttcacttgttattgttggaataactcttatgattacaggtgttttacttgttcttggagatgctcttggaaagaataatagcaaacatatagaggcgttagggccaaagaaatcttttataattggtatattccaaatgtttgcaattactcctggtatttcaagatctggttctactattgtaggcggacttctttcaggtcttaaaaaagaagaagctattgagttttctttcttaatgtctatacctgctgtacttggatctttacttttaaaatttaaagatattttagcaataggagcttcaacttcttttgttccacttatagtaggtttcttatgtgcggctgttattggttatttttctattgttttacttaacagcattgttaagaaaggaaaactttattatttctcaatttattgttggatagtaggtttagcacttattatctataatattttaattagattataaaaaagacaccatttggtgtcttttttatagttcgtatatataagaaataatatcttcataagaattgtctttttttaaatatccatttgggattgtacctagtttcttaaatccaagttcttcatataaatgaattgctgctttgtttgattttacaactgcgttaaattgaagtattttaaaattaagttcttttgcttttaaaagagaatgttctacaagtttttttcctatatgttttcctctcatatttttatctactgcatagcttgcatttgcgatatgggcacatcttcctatattatttgggtgtaatatataaagcccaacaattctatcattaatagttataacagcagtaaaactttgacttttaaaaaattcaaatccgtcttcttcatttaaacaatcaatttgaggaaaagcatttgcttgtgatacaatttcattccaaatgtcaatcatatcttctatatcatcttttttaaattctctgattattatttcttcttccattttttactccacattccatattttttctaaacttatattgctttgttcgataattttttttgcattattccattttccaatgtcattttttgaatgtgcatcacttcctactgcatacataacgttaattccttctttttcaattgacttaatatcttcggaatttaatttactttgtgtatcatttatttcaagcattatattatgtttattagcttcttttgcaatttttattatatcaacaggtcctctcgtatctggatgagttatcattttaagtggatatttattcattgcatttattattgcatttgtattaattttcgtttgtcttctcttaaaaataccaaatttacaatatagtgtgttcataaactgtaaattgaataatgcacttaaatttttaggaatagacattaaatgaattccgcagtataatacttcaattatatccaaaagttcatcatttacatccaaatcaccttttgtagaaattatatttgcttcaagtcccattaaaatttccatatcaggatatttttttcttaaagatataatttcttccttcattttaaggtatgtttcgtttgtgttatgtctggcaaccatgtgtccaggtccatgttcgcttattattatcttttttattcctttttctcttgccgctaaaacattatcttcaattgttcccgttccatgagaataaacggtgtggcaatgaatttctgctgtaagtttcattattttattctttcttcaatcctttctaagatgaaagatgcgatttcattggttttaatgcttgtaacttgttttcctttttcaaagaaaacagcattcccgttaccacatgcaacccccatatcagcttcttttgcttctccaggtccattaactgcacatcccataacagctactgtaataggctttttaatgtgcattgtttttttctttatctcttttacaattgatagtgtgtctgtcttacatcttccacaagtagggcaggatacaattcttaccccttcttccattaaaccaagacttgttaaaatttcttttcctacaattacttcatctgaacttttacctgtaagagaaacacgaatagtatctcctataccttcttttagaagtgttccaagtccaacgctggatcttactataccagtaagctcagcacctgcttccgtaacaccaagatgaagtgggtagttatacttttcactaaataatctgttagcatctattgttgttgttacatcacttgatttaattgataatacaatattatcataatcaaattcgttaaagtaagatatgcttctataagcactttccaccaatgcttccgccgtaggatgtttatatttttcaagcaagtctttttcaagactacctgaatttacaccgattctaacagggatatcatagtcttttaagcatttaacaacttctcttactttttctttgcctccaatattacctggattaattctaaccttatgtacgccatttttgattgctgcaattgcaactttataatcaaaatgaatatctgcaacaaaaggtatatttgtattttttattatttccggaataacttctgctgcttccatattgggaattgttcctcttattatatcgcatcccagcatttcaaggtcatttatttcttttataatgcttttatagtctgtaggaggaagttttaacatagattgaattaatacaggatttcctccgcctataactttatttccaatttttactacattagtttttttcattttataactctcctaaaaaagttttattacatcctgtacagctacaaataccgcaagtgccattaaaagaataaatccaatgaaatgaatagttccttctttttcacgattaatagggaacccttttatcatttctataatacaaaataggattctgcttccatctaaggctggtattggaagtaaattaaatataccaatatttattgctagaagtgcggttatgtttaaaacaattatgctacccatgctcatcgcttgatttacgattgttgcaacgcctataggtcctgataattggttaatacctattacacctctaattaaacttacaatagcttcaaatgttaaatatatatacataaagaacgctttaaaagcattagtaattgttcctataaaactccttgaatattcaggattaattcctattttgtaagaattagttgactcatctaaagtaggtgtaattgtagtttgttttgtttggttatcagatgttgtataagttacatttatttttttaccatttgatgatgtaattgcatttgaaagatcttcccagctatttatatttgtatcttctatttttacaatagtatcgccggctctaagtcccgaagtatacgcaggggaattttcaagtacatttgatattgttgttgtaggttctgtacctgccatagcgtatacaatcattaaaattatgattgcagtaattaaattcataatagcccctgcagctaaaaccaaaatacgtttaaaaggggaaattgaatttaaagagccttctccaaattcattttcatcttcatcctctccatacattttacagtatccgccaaccggaagaagtcttaaggaataaagagtatcatcttttccttttcttttaaaaagaagtggtcccatcccaatagaaaattcttctacgatgacaccacatttttttgccacaataaagtgaccaaattcatgagttgttattaataccccgaatattatcagtgtgcaaataattgataatgctatgctcaaattaatcgtctcctaaaaagtaagtatatttataacgatatatacataaaagaacgttcctgcaagggagaaaagcattccgtcaattctatcaagaattccaccatgtcccggaattaatttgccgtaatctttaacaccgaaagttctttttatcattgatgcagttaaatcaccaaattgacaaagtatactatctattattgccattattataaagtctattatagaaatgtcaagaatattatattttgtataaataaaatataatattatacctgctataataccaaataataatccgtaaaagcttccttcaatgctttttttggggctaattgcaggacaaagtttatgtttgccaaatttaactccaaaaatataagcaaaagaatctgttgcaactgcgattaaaattccgaaagtaataagtgctaatccttgattatttggtaaataattaatcattataaccataaatgaaagtattaaagatatatatattattccaaatacagaataaatcgttgtttcagaatggtattttttatttaatatattatttattgtaatgagtattacaataacaggcagaacaggaaccaataattctggcataataattgcaaagaacatcattatagttccaagcagaatatatattattttagataaatctaaatgttttttgttattgtcaaccacattgatatattcatatagtgctattgcatttacaataaaacccaaagctaaaaaagctttatttcctattattaacgcaataatcagtaataatattaatgcggctgcacttattattctttttgtcaatttatttcaccaatcctccaaatcttctttctttatgttggaaagagtaaatggctttatgtaattcttctacattaaaattaggccaaagtgtatcacaaaaatacaactcactatatgcaatctgccataataggaagttacttattctgatatctccgcctgttcttattaataaatcaatgtctgtattttcgttattatataaatatttgctgaataattcttccgtaatgtcttcagcattgattccctcttgtattatcctttttgtagcatttactatttcttttcttcctccatagttaagggcaatatggacatgaagtcccgtaccgtttttagttctttcaattgtatctttcatgctgtttaatgttttttcaggtagagattcaatatctcctatgaagtccattttaacattttccttaactaaatcatcggtttctttatttagatactcgataacaaggttcatgatagtattaatttcatcttttggtcttttccaattttccgtagaaaatgcatataaagttagatgttttatttttagattatttacttcctttattatatcttttacggtttttgcaccaaatttatgaccaaagcttctgattttcccttgttgctttgcccaccttccgttgccatccataataatggcaaggtgggcaggcatattgtttttatctaattcaaaattatccattttatgttttccttaaataaataattatattgttgtaatttctttttcttttgttttgatttttccgtcaatttctttaacgtattcatctgttaatttttgaatttcatcttcaaaatcttttaatccgtcttctgtaatttcaccatttttttgtgctgcttttaagtcatgtatagcatttcttctgatgtttcttactgcaacttttgcattttctccttctttttgagcaagcttgcaaagttcttttcttctttcttctgttaattgaggaatagaaagtcttataacttttccatcatttgaaggatttaaacctaaatcagaattcattattgctttttcgattaattttagagcagattgatcccaaggttgaactgttaaagttcttggttctggcgcagatatacttgccatttggtttactggtgttgggcttccgtagtagtcaactacaattctgtctagcattgcagggtttgctcttcctgctcttaatgcatttaagtttgattgtagattttcaactgctttaatcattttttcttttgtttgggcttttatttcgttactcattttttttctcctttattttattattgtaccgattttttctccacatactaccttttcgatattttcaggtggatctattgcgaatataagtaatggaatattattgtccatacaaagtgatgctgctgttgagtcaataacttttaatccttgatctaaaatatcaagataagttaattcgtcatattttattgcatcatcatataaattagggtctttattgtaaactccatctatattttttgcagataaaatagcttcagcttctatttctgcagctcttagagatgctgctgtatctgttgagaagaatgggttacctgttccagatgcaaatattacaattcttcctttttctaaatgtcttattgctcttcttcttatataactttcagatatttgtctcatttctattgcgctttgaactcttacttgtagatctaattgttcaaggctgtcttgaagagctaatgcattcattacagttgcaagcataccgatataatcagcagttgctctgtccatgccttcgcctgttcttcctctccagaagtttcctcctcctacaactatggcaatttcaactcccatgtcgtggcatttttttatatgttcgcttattttatttataacagatgtgtttaaaccaaatctcttatctccggcaagagcttcaccgcttactttcaatataattcttttgtatttaggttccataaaatactcctatctatcatttatcttttctttatatataatacaatatttacttaaataaaacaataaaaaaagaacacaactgagttaattgtgttcttttgttttgtcattatgcatttaattgtttttgaatttcttcagcaaagttttcttctttcttttcaagaccttcgcctgtttcaaaacgaacaattttgttgattttgatgtttgcaccggcttgagcaatgtatttttcaactgttaaatcaggatcttgaacatatgattggtcaagaagacaaacttctttaagttctttgtttaaacgtcctgtaatcattttttcaatgatattgtcaggtttttcaggatgttctgtttttgcttggtgaagtaaaatttctttttctgattcaatataatcgcttggaacttcttctcttgaaacatatttaggattcatagctgcaacttgcatagcaacatttctaaggcaagttttaacagcatcgtttacttcattacagtctgcttctacaacagcaccgatttttccgtttccgtgaatgtaagcagcaacgcaaccttcactaacgattttttcaaatcttctgatgtttaagttttcaccgattaccgcaattttttcgtttaatacttcttttacagtttttcctgcttcttttgcccatgattcagctaagaaagcatctaaatctttagcatcgcttactaaaacttgttcagcaacatcttcaacaaagttttggaagtcttcgtttttagcaacgaagtctgtttctgagtttacttcaacgataccagcaactttatcgtctttaactactacttttacagcaccttcagcagcgattcttcctgcttttttgcttgcagcagcaagacctttttctcttaaatatacgatggctttttcaatatcaccgtctgtttcaacaagtgcttttttgcagtccatcataccaacgcctgttttttctcttagttctttaataagtttagttgtaattgccataattatatccccttgataatattattcttcaacttctgttgtagcttcttcaactacagcatcttccatttgttcgccttgtttaccttctaaaatagcattagcaatagtagaagcgattaatgatacggctctgatagcatcatcattacctggaattgggtaatcaatttcatcaggatcacagtttgtatcaacaatagcgataattggaatattaagttttttagcttctgaaatagcaattctttcttttttagggtcgattacgaataatgctgatggaagtttttccatgtttttaattccgcctaggaatttttcaagtttatctctttggtttttaagtaagataacttcttttttaggaagtacatcaaaagtaccgtcttcttccatttgatttaattcgtgtaattttttaattcttttagaaatagtttggaagtttgtaagtgtaccacctaaccatctttggttaatgaagtgacttccacttttaattgcttcagtttggatagcttcttgagcttgttttttagttccgatgaataagatttctccgccttcttcagcgatttctcttgcaaatttgcaagcatcgtcaactaatcctactgtttgttgtaagtcaatgatataaataccatttctttctgtgaagatgtattttttcatttttggattccatcttcttgtttgatgtccgaattgaacaccagcttctaataattgtttcatttgaatgtaactcattctttttcctccttggttttttccttgatatgccaattcagctcataaacgagaaccaaagaatttaaagcatatctgtgattttttgtcaaccttgtttatgatatcataaggggattttatatgcaagataatatatgtatttttttatatttttttacctaaaattaaggctgtaaaggcttttgaggtgatttttaacttaaatatttatttttaacttattaattgtttaatcatataaaaaattaaagttcatatattttagtatgaaaaaaagaagaacattaaaaggtataatttatttattattaattattttcataggtcttgttatttttacatttgtttttaacggaatgtcattttctgtttcaaacatggattcaaatgttccttataacataaaagacttgttaaagaaagattatgggaaaagtaaatattatctatcaaaaggaggagtaagtatagatatagaaagggtattaaatgaaaattattttattacttattcttggatgagtggaaataaaagctctttttatgtagtttttttagtagaaaaccaaaataaaaatcccataagtaatcataaaattaataatttaaaagttgttgataatcttggaatggaatataaacccataaacttttattttgatgattatcctgttgatgagcctttaaaatataaagaaactttgaattttagattccttccttttaatgaaaatgtaaaaagtattacaatatcatttaattataatggaaatgattttgtttttaaaaacattccaatataaaaagcagtatattttatactgctttttatgataaaacaacttacattcctctatattgtaatgcttcgcttatatgggatgaatttatattttcttctccgtcaagatctgctattgttcgtgcaagttttaaaattctatgatagcctcttgctgataaattcaaattatcaaaagccattttcataagtttttcttcttcttctccgattttgcaccactgttctattttacttggagttaacatggagttaaaaagaatgttagttcctttatatcgttttagctggatttctcttgctttatttactctttttcttatttgtgcacttgtttctgatttagtactatttattcttaatttgtcatagtcttgtcttggaacttttacttgaatgtctattctgtcaagtaaaggtcctgatattttgtttttatatctttctttttgactatctgtgcatttacattctattttactgtctccaagatatccgcaagggcaagggttcatacttgcaagaagcataaaatcagcaggataggatagggaagcatatactcttgaaatattaacctctccgtcttcaaggggttgtcttaaaacttctaatactttcttttgaaattctggaaattcatctaaaaataatactccaagatgtgcaaggcttacttctcccggaattggtattcttcctcctccaattaaagatacatctgatattgtatgatgaggacttctaaatggtcttgtttttattagtggttcatctttctttaaaagtcctgatacagaatatatttttgtaacttccaaactttcttctaatgtcattttaggaagaatagttgaaaatctttttgcaagcattgtttttccgcttcctggaggtcctatcataagaatgttatgtgctcccgcagctgctatttccattgctcttttaacgctttcttgtccttttacatctgcaaaatcaacttctgataatatatcatcattttcaaaataattattgttaaattctatcttgtttattggttttctgttattaatatgagaaactacttctaaaatatttcttgcgggataaacatttataccatctataattgaagcttcttttgcgttttcaacaggaactacaatatttgttattccgttattttttgcttccataaccattggaagaactccatctactcctcgaagtgttccatccagtgaaagttctccgataaataaatacttatttaaatcaatatttgaaaaaatctgtgttgaagaaagaagtataccaattgctattggtaaatcataaaacgttccttctttttttatatttgcaggtgctaagtttattgttattttaccaagtggtatttggaaagaactgttttttattgctgcaaaaactctttcttttgattccttaactgcaatatctccaagtccaacaacagccattgaaggaagggctttgttaatgatatctgtttcaacgcttacgattattccgtcaactcccataatgcttcctgaatataatttactaaacatgtttattacctctatattatttcttttatttaatattagtagaacatatgttcattgtcaataatatgagagtatctggtcactttttggtcacattttttaataaataaaaaacactgtaccttagtacagtgttttaatttatctttattattcaacatcaataacagttacatctttatatgttccgcaaacgctacatactctgtgaggagcttttacttctccacattttggacaaacgctagatgcaggcatagcgattttataactgttagctctttttttgtctcttcttgctttagaaatttttctctttggtactgccatgattattcacctcctagttttcaccttcgccctctaatagtttactaagtgctgcaaattttggattgattttatttttaccacaatcgcagctttctttgtttaggtttataccacaatctggacaaaggcctaaacaatcatccttgcataaaactttattcggcatatttaataaaatttgttctcttacagcttctttaaggtcgattccttcagcttcactgttttcaatctctttgatatcatactgtttttctaaaggaaaatcttcatttttttggatatcttccaaacatctgtcgcaggttgtaaaataagtaaaaagtattttacaacttaactgtaaaatatcagactgcttaaatacttcaccttttacattaatgtttgaaatttgaaaatctttataagaaaaatcttcaaggttttcatcaattaaaagacactgattatcgctatctaatatttttttaagtttaataatcaacttttttcctcctagcgtcacagtaagaacaattatatatctttagctataatttgtcaatatattattattaattcttggctattttaatatatttattgtttcttttgctatcattaattcttcatttgttggaacaaccatgcaagttgtttttgaagaaggttttgttataacttgatcttttcctcttacattgtttgcttcttcgtcgaattcgataccgaagaattccatatcttttaatattgcagctctaacatctgttgagttttcgccaataccacctgtaaatgcgatgcagtcaactccattcattgcagctgtgtaagctccaatagttgtttttactctatatacaaatatatcaaacgcaagttttgctctttcgtttcctttttccatagcatctgttatgtctctaaagtctgaagatactcctgaaactccaagtaaacctgattctttgtttaaaatttcttcaacttcttttggtgttttgttttctttttcgcaaaggaatggaattactgatgggtcgatagaaccgcttcttgttcccatttcaagaccatcaagaggagtgaatcccattgagttttcaatacattcccctttgtttacggcagaaatactagcaccattacctaagtgacatacaattacttttaaatcttttacatctttattcataagttcagctactttttgtgatacaaattgatgagagattccgtggaaaccgtattttcttatactatatttttcatagtattcataaggaataggatacatataagcttgttttggaattgttctgtggaaagatgtatcgaatacacataccatttcttttccagggaatacttctttacatcctaaaagacccattacttgtccagggatgtgaagaggtgcaagctcactgcattcttttaatccttcgattacttcatctgttgctttgattgattcattatatttttcgccgcctgttgttattctatgtccgattgcagaaatttcatctaaactgctaataacaccatattctttatcaacaagagcctttactaaaatttgaagagcttctttatgtgtaggcatgtcttcattaaatactacattatctttttcaggttgtttatgtgttaaaattccgtcctctaaacctattctttcagctactccattagctaaaacattgttgttatccatatcaataagttgatattttagcgaagagcttccgcagttaattacaagaactttcattaatatatttcctcctaataaatgtaaactgtttttatttgtatttgaaaaattccttattattttataccctttttgttgttttgtaaataataatgtaggtaaatattttcataattattttaatatttttatataaaagtataattagatttgagtttatatgataaaatataataaaaatatttttaaaggagaaagttatgattgcattaattatcattttaattgttgctgctgtaattattctatacttaatatcagcttacaacaatttcgtaaagttaaataacaaaataaaagaagcctttgcaactatggatgtttatctaaagaaaagatatgaccttattcctaatttagttgaaacagttaaaggctatgcaaaacatgaacaaggcactctcgaaaaagttataagtgcaagaaacatggcaatgaatgcttctaatgttggagataaaatcgaaggtgaaaatgttctttcaggtactttaaaatcattatttgctctttctgaaaattatcctgatttaaaagcaaatcaaaattttgtttctcttcaaaatgatttaaacagaatggaagaagagattgcttcttcaagaaaatattataatgctatagttaatacttttaatacaaaaacagaagtttttccaactaatattatagcaaatatgtttggtttttctaccaaacctttatttgaagtaaacagtgaagaagaaagagaaaacgtaaaagtcgaattttaacatttaggtattaatatgaaaagaacaaaaaaaattgtaggcttagtattattatcgcttttacttttgcttccatcaataaatgtttttgcatcggaagcatttaccatagataattacaaaataaacatggtagtaaatgatgataacagctatacaatagaagaaacaatagatgtagattttggatataatcaaaaacatggtatattcagaacaatccctacaatttcttctgctacaagaaatattgatggaaaagatgtaaagaaaacacatttaattaaagtaaaagatattgatgtagttggaagtgattattctacagaaagaaattttgataatatagtattgcaaataggggatagtgacgaatatgtaaccggtaagcaaacttataaaattaaatatacttatgttgtcggtaatgacggaataaatgagtttgatgatgtttattttaaccttataggaaacgactgggatacaaccattgataaagtaacctttacaattaaaatgccaaaagattttgatacaaacttaattaattttacatcaggttcttatggcaatacagacagtaatgtagagtatagtgttgataataatgtaataaaaggatatacaacttctaaactttataatcatgaaagtgttacagttagaatagagcttcctgatggatattttgtaaatgcatcttcaaataataaattatttgatgttatctttcttatagtttcagtattaatattaatattatctttatttgtatttacaaaacatgggaaagatgaaaaaataataaagacagttgaattttatcctccaaataacatgactccggcagaggttggatatattgcaggggacagttggagtgataaaaatctaacatcaatgataatatattttgcatctaaaggatatcttaaaataagagaagaaagtgaagaagaacttacttttataaaggtgaaagatttaccaaaagatgcaaaactttatgaaaaatgtttgtttgataatttgtttgcttcttctgatgaagtgaaattatcttcacttaaatataagtattcttcagcactaacacttgcaagagatgatttgcaaagtgagtttagcggagaaaagagtttaagtgatagagttgctttaaaaatgcagcgtataatgaccggtgtagtctgtctatttacatttataagctatacttatactttctatcaaatattttatagtatgcttataagcttaattttaggatttgcatcaactgttttaataggcggtatttatatatcaattatttatttgataagtaagatacacaccggaagtaacaaaagtaaagtttttgggatagtattttgtttgattttatatgctttacttatgggagcaatgtgttttgttttaaatattttatcttttagcgtgattttttatttattacaaaatattattttaaccataagtgtatttttaacaggtatgacatataaaagaagtaaatatttagatagtattattggaaagatacttggatttaaagactttttgattgttactgaaaaagataaacttgaggcattggttgaagaaaatccttcatatttttatgatataatgccttatacatttgtacttggaataagttcaaagtggatggataaatttaaagatataacaatggaacctcctacatggtatagttcttataattctcctacattttgggattattatatgatgtcacgtctatatgatagaatgttgtttatgaatagcactgtaagtgcagtagaagtaagcgatatttcttcaggtggtggcggtggcttttccggtggaggaggcttctctggaggcggcttcggcggcggtggcggcggaagctggtaggaaattatggataggaaaaaagaaaaagttcaagaaggtgtaattctattaattttagccatagttataggagttgttatttatgtaacacagaagctttttagtaaaaagcttcctccaaatatattaactatacttttactttgtgctgtggctttacttattttaaatttaataatttattttatatggggtaaagataaaaaggttaatcaagaaaaagctgtttatcctccaagtggtatggatggatttgttgcaggatatttagatacaggagaagttcaaagtaatcattatgtatccttgatactatcccttgcaataaaaaaatatattagtatttttaaagatatagatggaaaaattataataaagaaaataaaagaattagataaatacacaacaaagtttgaaagatttatatataaaattctttttaaagggaatagaaattctgttagcagcaaggaattgtttgaaaatgaaggacattatttttctagaatggaaaatattataaataattcttattctaaagatagtaatattgaagataaaacatcaagattttttagaagattgacaggtgtattatttgcaattcttcttattgcgtcattcataatatattcttactttgcttttagagcattaagatttagagttgcttttacaatattattattgattttagcgggatttatgtattatctattgtcccatttaattgttgcatatcaaaccagtagtagtacttatgttaaatatgcggtgcttgttacaagcatatttatactttgcggtaatatatcagttccctacttttcaattcattacagtaatattggtattatgtttgtttgccaacttaacttgttactgttatgtgttattgtaaatgggtttatatttaaaagaagtgaacacttaaactatgtgatatcacaattaagcgggtttaaaaataatctgaatcagtttgataaggaaagtttaatatcgttatataacaattatagagaatacttttttgaaatacttccatatttattttctttggaactatcaataattttatttgatgaaaatgaggataaaatagaaatgccttatttctattcggtttatgatgaaagaaaagaaatttcattgaatgattttaataatgatatggatatactagatgatgcaattattcattcgtattaaaaaataaaaagacttacatttttgtaagtctttttatttttttactttttttgcatttgcattattaaatgtttctattctttcacagaaaaccttacctgcgttgtaatccatttcgtttacacgataatttcttgctatcgtttctattattacagccatatttcttccaggtctaacaggtactgttaatttgtcaagagaaacatcaagtaattcttctttttgatattctgtacctaatctttcataatgtttttcattgttccaatgttcgagtctaactattaattctatatcaactttatcctttattgcacccattccaaataaagcctttacatcaataataccgactcctcttatttccataaaatattgtaatatttcagggcaagaaccttccaaagtattgatgtttagtcttttaatttctactaaatcgtcgcatacaagtctgtgacctctttgaacaagttcaagtgctatttcacttttacctataccactttcaccttcaagtaatatacctacacctaaaacttcaacaagaacaccatgtagctgcattttaggagcaaataagtcttctaaaaatgctactgttttatttatacttaagtttgtattgaagttacttcttataagtataacgtgttcttctcttgcaattttaacaaattcatcatattctttaacaccgtttgttagtactacacatggaatgtcatgcttaaataatgctcttattctattttctctaacttgaggtgtaagatgttttaaataagcattttctgtatttccaattatttgtactctgtcattatcaaagtattcaaaaaatcccgttaattgtattcccggtcttgttaaaaatggtgtgtttagtttgatatttttcctaaaatcgctgtataatatttcgccttcaagattcttacaaaattcttctaaagatgctcttttcattattccttacctaacatatatttatttattatataagcaacgccttcttcatcattgcttggtgcaactatatctgcaatttttaatacttctttgtgtgcatttttcattgcaactccaagggaagcatattcaatcattggtatatcgtttaatccgtctccaatgcctattgtgtcttcatgttttatgttataagcttttgccacttgttttatagcttctgctttatttgcatttttatgagtaaattcaagtaaaaaactttggctcgttgcacttatggcatttgtaccttttaaaagttctttactgtaaggaatatgctcttctactttttcagggtcatcctgccatagtaatttggcaattttgttgtctttatcgtcaaaataacttaaatcatcacctatgtataaaacatcgtctttatagtttgaattatcaagataatgttttgtgtgtctgtttttttcattaaatgcaatttttccgtctaatgtccaaattattactccgacatttcttttacatccttctttataagttaaaattgcatcttctttatctaaacctttttgatataaaactttaccgttttttccgcttaatatttgtgctccattgtaacaagcaagaggcatatcaatatcaagttgatctgttataaggtctaatgttaccggagctctccccgagcataacattaccacaattccattgtcagaagcttctttaagaacttcttttgtgttttctgttagaattctttttgaattaattaaagttccatcgatgtctgttgctattaatttatacatttttttctctctttcaaaaagttaatatattgttatttcatttttattttatattatttattttttttttacaatataaatataaaataatacgtaaagtatatgttaatagagtataatctatttaaatataattatatgttatttaggagaataaaaatgaaaataatagatttatctcataatataattaataatttacaagtttatccgggagatcctgagacaaaaataagaaaacattgtacttttgacaaagatggatatatggttaatgaacttagtatatcgacacattgcgctacacatatagatgctccaaatcattttataaaagatggaaaaggaattgatgaatatcctatatctaaatttattggtaaaggaatagttatagatgtaagttataaaaaagaaggtgaaatnnnnnnnnnnagagttgaaagaatataagaataatatttgtaatgtagattttgttatttttagaacgggatttagtaaatattttaacagtgaaaaatatattcatcatccttatttatcaaaagaggttgccttaaatttaattcaaaataatattcaaatatgtggaattgatgcttttagtttagattctacatctaatccttctgattgggcggctcatgataatttattaaaaaatgatattttaattgtagaaaatttaaataatttggatttgcttaaagataataaaatatatgaattccattttgtagctcttaaattaaataagttagatgcttctccaattagggcttttgcaatagatggttaaatatataaaaattttataaggagaaaattatggattatataaaagaatataatagatttttaagtagtaatttgattgatgaagaatcaaaaaaagaattattaaacattaaagataataatactgaaattgaatatagattttcaaaacttcttgattttggaactgcgggacttagaggtgttatgggtattggaataaatatgatgaatatatataccataaggcacactacattttctcttggaaaagttattttaaatgaaggagaagaaaaaagaggcgttgttatttgccatgacccgagaaataattctgataaatttgctcttgaagcagctcttactctatgtaatatgggtataaaagtttatttgtttgatgaccttagaccaactccggagctttcttttgctataaggcatcttaaagcaatttcaggaataaatataacagcttcacataatacaaaggaatataacggatataaagtttattgggaagacggagctcagctttctccagatatggcacataaagttcatgagaatatgataaagatagatgttttaagtgatattaaaattatggaaaaagacgaagctgtaaaaaagggactacttaaaattattggagaagatattgataatatttatttggaaaaagtattatcagaaagcgagtattcaaaatatacaataaagcataaagatgattttaaagtagtatatacaccttttcatgggtgtggatataaatttgtgccatatgtgctttcaaaaatagggctagataatattataaaagttgaaagtcaaatggttttagacggaaatttctcaacggttaaatctcctaatccggaaaatgcagatgggtttaatgaggctattaaggttgctaaaaaaaataatgcaaatataataataggaactgaccctgatgcagacagagtaggggttatggcaaaagataaagacggagaatataaagttataaccggtaatcaagtcggagctttgcttcttgaatatataataatggcaaagaaagaaaaggcagaatttgaaaataattttgcaattacaaaaagtattgtaactacaaatatagttgacgaaatatgtaaaaagaataacgttaaactttatgaagttttaacaggctttaaatttgtaggtaagaaaataaaagaaattgaagaagaaggtatatacaaatttatatatggatttgaagaaagtataggttatttaaagggaagttatgcaagggataaagacggaatagttacttcgatgcttgtttgtgaaatggcttgttactattatgataaaggaatggatttatttgatgctctaaactgcttatatgaaaaatacggttacttcgatgagctaacggaaagtatttatatggaaggtttagatggggaagagagaataaaaaacataggggtaaaattaagaaaagatattcctacaaattttagtggtactaatgtaataagagtaagagattatcaaaaccatatcattacaaatttaaaaacaagagaaaaagaaaagcttaatgaagttacttctgatgttttgttttttgaacttgaagatggatgcgatataatttgtcgtccaagcggaactgaaccaaaaataaaattatatattttatcaaaaggaagttctgtgaaagatgcaaaatataaatctagaaaatatatgaaatcaatcaaagaaatgatttaaaaacaccgatgaaacgaaaagttgcattattataataatgggtagcagacttttaatatgcttttttatatgattataaaaaaggaggcaagtatgaattttggagaaaaattaaaaagtcttagaattaaaaatgaatactctcaggaaactttagcagaaatgattaatgtttcaaggcaggctgttactaaatgggaaaatggaaatggaatgcccgatatagaaaatttaaaattaatagctgatatttttgatgtaacaatagattcacttgttagagatgaagaggaaattgatacattagatgaaagtttttgttttaattttgctctttatacggggattattttcttttgtataggatttttattaaatagttttttggatgcagttgatattattttctttcccataataggaggaattataggatatattataggatatttgattataaaagtgaagaataaaaaataactcatattttgagttattttttattttaatttatattttccttttcctgttttttctatttgtccgctttgacaaagttttgttaatactctttgtagttgtcttctactgcatcgaagttttaaagcacttgcgtctattccttcaagtttatttgagggcgatatgttttttaggtacaataaaactctctgttcaacggtttctgctgcagcttccacaaaagcaaaaaattgtaatttttcactatatgaacggagtaataaatgtaaaaaaggaatatcattttcaagttctttcttatatttttttattgataatgcaagacaagtcacatctgttgctgcatccgtaaaaaaagggggatttccctggtttgtgaattctatatcacctattattataggggctttttgctggtttacaggagagattgttccgttgtctcttaaaccatatattctgattattccatcggttatgaataatatatcatcgagttttttgtctggtgatgttatttgttcgcctttatcatatttatatattacgaattttaaattttcggtagaaaaatatttttttatatttgtctttttaagtattttttctatttgttttagatcgtttatttttttcattttaattactatctcctttagctattgtgacatatggcacagaaaaaatcaacttaatatattaaaataaattgaaattgaattaaggagaatttaagattattatggatagtaagatatttaatgatgaaaaagtatcgagagcatatataaaattatccttaccacttgtttttagtatggtaataacacttatatataatttagcggatactttttttgttgctcaaactaacgatacgaatattgttgcaggtgtgtctctgggtatgccgttgtttacattgttgatggctgttggtaatatttttggacagggcggagcgtctttaatatcaagacttcttggaagaaaagatgaaatatcagtaagacaagtaagctctttttgtttttatattacgattataacaggtcttataataacattattaatgcttatatttcgtattccccttctttatataatcggagcaaatgaagaaacattttttcatgcatcaaattattatttttatttagccatcggtgctcctgcaataatgctttcgtttattcattcaaatcttttgcgttctgaggggatgtctaaagaatcaatggcagggacaataatcggtgcattggtaaatataattttggatcctatttttatatcttattttggatggggtgcaggaggtgccgcaattgcgacagtaataggttatatatttacggatattttctttatatttatagtattgaaaaaaagtaaaatattatcagttaattttaaagaattaaaaataccattaaaacatgtatggcaaattcttggaataggtattcctgcggctattgtaaatcttatgcagagcgtaagtgtggttttaatgaatcaatttcttcttccttatggaaatgacaaaattgccgcaatggggatagtattaaaagtaagcatgattgctcttttgcttttaacaggacttgcttttggaggagagcctctgtttggttattactatggtgcaggagataaaaaacgtcttgttaagttattaaaattttgtctttattttataagcattgtcgcaatagccattacagctgttatattcatttgtgctccaatgatgattaaatgttttatgaataatcaaagtattattgagcagggaactataatgcttcgttttcaggttataacaatggtttttgttgggctaatacttttaatgactataatatttcaatctatgggtaaagttgtaggctcttttattctatcaataagccgtcaaggtattatctttttagctgtattaattatatcttatcatgttgcaggatatatgggtataattatgtcacaggcaatttctgatggtttgaccgttataattgcttttatattattttataagcagctttataaagaatttttttaatatttgataatttttgtgcatttttatttaatctataattttatattataagaactcagacaaaatctgagttcttttttataaccattcgttgtgtttttttgtatagtttttatttttgtaaagttcaaaattgataacgaataaattttattattgattcataaacaaaaaccgataaattatacacatttatataaatataatttctataaaaggaggcgtattatgttttttaatgtagaggttgatgaaattatagaaatgttacatagtgataaagaaaaagggctaagcgaagaagaagcaaatttaaggcttgaaaaatatggagaaaatattttaattgaggaaaaaagaaatacttttttagatatctttttatctcaatttcaggattttcttattattgttcttttaattgctgctgctgtttctttttttataggagagggaagagatgcaattatgatactagttatagtaatagtaaatgcgttaatagcatctttccaagaatataaggcagataatgaacttgaggcattaaaagagcttagtgttaacgaagcaaaaataataagagatggacaagttataaaagttccttttaataaagttgttgtgggagatatagtttatgccgaaagcggtgatttaattgccgcagacggaagaattataaaaagcaataatttgaaaatagatgaatcttctcttacaggagaaagtatcccaatagacaaagataataaaattataaaagaagagaaagttgctcttgctgaaagacgtaatatggtatattcttcgggaattgtaacttatggaaattgtacatatattgtaacggctacaggtatggacagcgaaataggcaaggttgccaagatgattacatcgcaaggggagaatataactccaatggcaaaaaagacaaaagaaataggaactgttctttctcttggatgtttagggatttgtattgctatttttattataggttttattcattgtaataaacctttaaatatgtttatgacaagtgtttctcttgctgtcgccgcaataccagaaggtcttcccagtgtaataaccattgttctttctataggtataacaaggcttagtaaaaaaggtgctattataagaaaaatgcatgccgttgaaacgctcggaagtgcaaacgtaatatgttcagataaaacaggaacattaacacagaataaaatgagtgtggaaaaagtttatattgcaaatagaattatagataaagatgagttttctacaaataaaagcatagcttttaaaatgcttattaatgttgcgtatgattgtaacgatgcaaatctttattatgatgaaaaaggtaaagaagttaaaataggggatagcactgaggttgcattggttagacttgcaaaagaaagtggaatagaaagagaaaggaaaattagatttgacgaacttccttttgattctaaaaggaaaatgatgagctgcatttatagggaagataataagtatatcgtgtatgtaaaaggggctagcgatgttttgataaataaatgctctcattatgtttgtgaatctaatgtaaagaaaataactgatgatttaagagaagattttttatctcaagtggacaagctctcaatggaagcatatagagttatggggtatgcttataaagttttggataatttacctgataaagaaaatgtagaagataatctcatttttgtaggtcttacggctatgattgatcctccaagggaggaggtatttgaatcaattgaaacttgtaaaaaagcaggaataaaacctgttatgattacgggagatcataaacttacagctgaagctattgcaaaaaaacttggaatattgaaaaatgatgaagaatgtataagtggattggaacttgaacatttaagtgataaagcacttgagaaaagaataaataatataagtgtttatgcaagagttacaccgaaagataaagtaaggattgttaaagcttatcaaaaaagtggtaatattgttgcaatgagtggagatggcgttaatgatgctgcagcacttaaaaaagcagatataggatgtgcaatgggaataacagggacggatgttgcaaaaagtgcctctgacatgattttatgtgatgacaatttttcaacaatagttatggcagtaaaagagggtagaggggtattccaaaatataaagaaagccatacattttttgatttcttgtaacatcggagaaattattacattgttttttgcaacaatacttaattatcctatgcctctacttcctatacacattttatgggtaaacttagttacagattcgcttcctgcacttgctcttggagttgacccttcagaggaaaatataatggaaaagaaacctgaaaagaaggataacaatatatttactcctggttttagcataagagttatatttgaaggattactaattggtttcgttacattggttggtttttggtttggtaatacctattattctcttgagacgggaagaacctttgctttcttgatactttgcttatctcagttatttcacacatttaatgtaagggcaatgaatgaaagcttgtttgataatgctccaatgaaaaataaggttcttatacttgcaaatatagtttcagctttgcttgcaataatcattgttatagttccattttttagagaaatatttgaattatctgcacttgatccaaataagtgggactttgttttaactttatctctagttcctttggtaagttctgaaatcgtaaaacttgcaaaagacttgtttgtggaagaaaatagtcttttgaaacagggaagaaatgataaacaaaaaaagactgcttaaacagtcttttttatttccatgaattttgtatgttttcaagtatttctacgttatgtattgtcatttcttttgttataacatcacttgttaatttgccttccataatgcaactattaaaatgattaatttcatatgtcatttcacatgtagcaggatgataaatttcttcatcttctctgtcgtcataatagtgtattgtcattttatcagctttatagaagttatccatttcaatgtaaccttcacttccgtatataaacaatttgtttaataatttaacatatcctgatattttgcttgtagctagagtatcatttcctattttaaagttaagtgtacactctttatctccaccaaattcttcgcttttaagtctcattccaaagtactcgcttattggtttacctaaaacatattcgatatattctatgcaatatactgcatttgtaaaaaatactccaccaccttttgataaatcaagagtccaggcattataatctccagggaaagaagtcgcaaaatccataagacctatttcaccgatttgtttttctttgattatttcttttactttatttgtaacaggaaggaatacttctttttgtgcttctgctaaaaatagatttttttcttttgcaagttcaaataattcttctgcttgttttttttctaaaaccaatggtttttcgcaaactacatgtttgcctgcgtttaatgcatctttaatattttgataatgagcaaagtttatagttgctatatatattacatcaacttcatcatcattatataattcttcatagcttccgtagtattttcctatatttaattcttctgctttttgttttgctttttcttctcctcttgaagctattgcaacaacttctccgttttcgctttctcttacaccttttacaaatcttggaactatcgacgctgtgcttaatatcccatatttaaccattttactatctcctcatattttatatagataattatacactaaatagatttattactaaagtataacttcttgaatttgaataatttaaagggtataattatataataaatttttaagataagggatgataaaaatgattatagcgtttaccggagcaggtatatcaaaacaaagtaatattccaacttttatggaaagacctgatgtaagagaaaaactgtttagagattttgccatattacatccaaaagaatataacgaaacaatcagacaattaaaagcaaatatgaatggagctgagcctaatgatgctcattatgctttaagtgaatacaatattccaattattacaatgaatatagatggactccatacaaaagcgggaagtgaacctttagaacttcatggggggctgcctgaagatgacgaaatggatatagcatataaattacgtaataagcctgttttatatggagatcctgcaccaaattaccaaaaggcttatgaacttgtttctacaatgaaacctggcgatgtgtttcttgttataggctgttcttatcatacagctatcgcttgtgatttaagagaagtagcaaaaagcagaggtgcaaaaattgtagagatacaagaagatgctcaaaaaaatgtaagaaaagtattagaagaattgacaaaataaaaaataatatcttgggaaagaatattattatattgttttcttaggaggtaagattatgaaagacgattatttgcaaggtatattggttgccaataagaaacttggcgttcttggttgtagtcaagatgtatttacacaacttgaaaaatacaatgatgaatttttagatgaccttttaaatgctcttgtaaagtttacaatgattgaaacaaacggtgttgtaaataagtttgcaagatatgatacttgtgtaggtaatattacaatatatactaaaaaaggaccaaatgacgaagtgtatacaaatatattattttccggagagattatttagattatgaaatatataaaaactgactttaaagtaccttactataacatggcttttgaaaattatgtaatgaataatgataagttcgatgatgattatttctttttttatattcacgttccttcaattatagttgggaaacatcaaaatacaatcgaagaaataaacagtgaatatgtagaaaagaataatattattgttgcaagaaggaatacaggaggaggagcagtatatcatgatgaaggaaatttgaatttttctttcattacaacaaaaaaagatgatataaaagaaattgattttgaaaaatatactactcctataataaaagcattaaggaaactgggaattgatgctgtattaagcggaagaaacgacatacttgttgatggaaaaaaaataagtggaaatgcgcagtgtatgaacaaaaagaaagtgttacatcatggaactataatgtttgatgttaatgttgaagcacttgttaatgctttaaatgtcagtgatataaagataacttcaaaggcaataaaatccgtaagaagcagggttttgaatattaaagatatgataaacagagatatggatatttatgaatttaaggattttattttaaatgaaatatataacaatgaggatattgatgaatacatactttcaaaggaagatatcgaaaatatagaaaaactggttaaagaaaagtatggaacctgggactttaactatggatattcgcctaaatttacaataaaaaataaaaagaaaatagagggcgtaggtataattgatatcatgcttgatataaaagacggacttataaatgatattaatataagcggagattacttttctgttaaagaaacaaaagagcttgaagataatttaaaagggataagatataaaaaagaagatgtatttaaacttttaagtaatataaatatatctgattatattataaatattaaaaatgatgattttattaaaattttatttaatgaaaaagctagagtacttgtctggagacggactgggagggtaggtagtcgcggggttttttttattcctttgaacctatgaactaggttctttttttatttccttgtcttgtattatgtctttatctggttgtatgttactttacttaaataactcttgatattttttatatgttttattctatttgatttgaatttttatataattaaataatatgtttatatttttttatatatttttgatatataaataaatttttgtgttataataagtcgaatattcatttaaaatgtcgatattaaagggtaagttaatgaaatttaagaagaagtatttattaatttttatagcaattatttttatttgtttttattttgttttttcaaattttaaatatgagtcaaatgtttttccaaatgggataagcataaatggtgttgattgttccggacttacagtaaacgaagcagagaaaaaaataaccaaagaatggaataataaagaatttattgttaaatcatcaaatactgcttttaaatttgatgttccaagaacttggtcgacaaaagaaatattatccccaaatgaacaagttacaaagtttatggaagaagaattaatttcatctaaatcaaatgaacaagtattcggtaaaataagcgattttggttttacatatgatatagaagatgatttaaataatatactaaataaaagtaaatttgaatttttcttaataaaaattggtttatttaacgataatattagaattaatatgagtataagtaaaacacctgatgagtttaataaaaaaataagttctcttgatatttataatttgtcaggaaaagtaacaaaaacaaaaaatgcttatataaacttggagagtgctaactttgatatagtaaaagaagtttatggtaataatattgataaagaattacttacaaacgaaatagtaaattatatttcaagcggtaaattttccatgaactttattcctgaagacttttatgttaaacctgatattttatctacagataaagagcttttagaaaagcaaagttatttaagagaattagacataccatcaattacatataaaatgtactgcggaaatgtagaagtaaataaagttgatatattaaaaatgtatggtataagcgaagataatttatatgatgattttactcttggtgaattaaaagttgatgaagaaagtgttaaaaattttgttcataaacttgctcagaaatatgatactgcttggtctgatcatacttttaattccacaaagcaaggaaaaataaccgtaagcggtggggattatggttactttatagatgaagataaagaaatagaaaaattaatatctgaattaaagaataaaaaagatataacaagagaacctaaatattctcaagagggatataaaaatgctaacgacattggagatagttatgttgaaattgatttaacatatcaaacattgtggttatataaagatggaaaacttattatttcaatgccggttgtaacaggaaatatatatgcaggatacgatacacctcctggtgtttatatattaaaatacaaaacaatgcatgttactttaaaagggcaaaacgcagatggaagtgattatgcttctcctgtaacttattggatgccgtttaacggaggtatcggaatgcatgatgctaactggagaagtacattcggtggagaaatatataaaggtggaggaagtcatggatgtgtaaacatgccgccaagtaaagccggaattgtttatgataatattgaggctggatatccaattgtagttcattattaattttaaaagaggtattttaaaatacctctttttttgttataaataaagtacagtaataaaaaattgttttattaaaataaaaaggaaaagaaaaatgaatcgtacggaaaaatttatacaactttatactaaacttgaacaaatcgcagtattagaatatggatttccaaaggatggaaaaagcattacaagattaatgaatttgaaatgttataaagatataagaagggaacttgcatattgtaaggaaataagaaatattttacagcataatcctaaaataaataatgagtatgctattgagccaaatgaagcaattttagccttgttagaaagtattataaaaaaaatagaatcaccaaaaaaagttgttgatttttataaacccattggtaaaataataagtgcaaatattggtaataatataatggaatatatgagaaaaatggagcaaaaccaaattagttatatacctattcttaatgataaaggcattgttagaggagtatttggagaaagtacggttttccaatgtgtattggatgaaggtataaatgaaataaatgaaaatacaaaattttatcatataaagaaatatttaagtttggataatactataacaggtagctttatttttacaaatgaaaatacgttaatgattgaattggaagatatactttataaagcatataaaagtaataaaagaataggtattatatttattacaaaaaacgggaaagaaaacgaaaggcttacagggttaattactccatatgacataataggtaattaataggaaaatgagatggaatatacttttactcaacaacttataaatatatgtgaaattataggtataattgcatttgcaatctctggtgcaatggtggctattgaaaaggatttggatatttttggagtagttgttcttggggtaacgacggctttaggtgggggagttatcagagatttaatacttgcgataaatccacctacaatgtttataagcagtaattatgctgcactggctgcaatatcgtcgcttgtaatatttattttttcatatttcaactataaatatatccaaaaaaatagaaaagtatttgaaaatgctttaaatttttttgatagtataggtttaggtgtgtttgttgttcttggggtaaacacggcaatgtatagtggatatagtgataataattttcttattatgtttataggtgtaataacaggtataggaggaggaatactcagagatataatggttaaagatattccttttattcttagaaaacgaatatatgctcttgcagcgatactgggaggcggtgtgtatattgttctattaaaaaatggaattaattcgaatttttcattgatcataggtatatttattacaattttaattagagttttatcaaaaaaatacgaatggtcacttccaagggtaaaaaaataaaaggtaagaaattaatcttaccttttttatttttgttcaacaatttcaaatccttgactttcaaattgttttatagttttttctaaagatattttactaacattacttccattagttataaaaatatttgcattagctagttgtttcatattatcttttgtaaatgtaacttctatagtttcatatactactttattttcttcttttatgtcataggttagcccttcaattgattcaaattgtttttttaatatatcattttgattatataaactttctatttgcttatctgaataattagaaatatctattgatgttacttgtttgattttgtctattgtatccccctttgcatgtaaagttgcttgtatttctactccagcggcataatcacattttaatattaccgtttgttcttttcctccgcagcctgttaaagaaaataaagataaaatcaatgtacatacaagaatagctttaaatatttttttcataatttccctccgtaatattttgttaaattaataatacaatacttgtaaacgttttgcaataaaaatattatttatttattgacaaaactgattatactgtatatactgtatatatacagaaaacaaagaaaggatgaatgctttggatataattataagtaatatagacgataaaccaatatatgagcaaatatacatacaaataaaaaatatgattgtatccggtaaattaaaagaaggtgattctcttccttctataagaaatttagcaaaagatttaagaataagtgtcataaccaccaaaagagcttatgaagaactggaaaaagatggatacatttatacggttaaggcaaaaggttcatttgtaaatgaaaagaacataaaactaattaaagaagaaaacctaaaaaagattgaatttcatattaaagagatattggatttggcaaaaataaatgaattaaaaatagaagacatttacgagatgtttgatattattttggaggagaatgatgaacgcaattgaagtaaaaaatttgacaaaaaggtatagtgattttactcttgataaaataagttttacacttccaatgggatgtataatggggcttatcggagaaaacggagccgggaaaagtacgacaataaaattacttcttgatgcaattacaagagatgatggagaaatatttattttaggtaagaataataaagataattttaaagcaaccaaagaagatattggcgttgttcttgatgaagctcactttcctgaaagtattaacccaaaacaggttaattccattatgaaaaacacatataaaaattgggatgaaaatacattttttaattatatgaaacagtttgagttgcctttaaagaaatcttttaaagatttttcaaggggaatgagaatgaaacttatgattgctgttgcattgagtcatgatgcaaaattacttattttagacgaagcaacaagtggtcttgatccaatagtaagggatgaaattttagagctgttttatgaatttacaagagaggaagaccactcaattttaatttcttcacatattgtttctgaccttgaaaagctttgtgattatatagcttttattcataaaggtaaaatgttatttgtagaggaaaaagatgtgcttcttgataattacagaatattaaaatgttcaaaagatgattttgaaaatgttgattcagactgtattgttggactaaggaaatctccttatggagtagaagctttggttttaaaagaaaaaattaatcctgtgtttaatttagaaaaaccaaccattgaagatattattgtttttatggcaaaggagggaaaataagatgaaaggtttacttttaaaagatatgtatgaacttataaagcaatgtaaatttattttacttttttgtgtagtatatgtttttttatcttatacagaaagcggatattttttcttagctttttcaataatatttttctctcttcttccaactacaattatggcattggatgaaagaagtaagtgggaaagctatgcgataacaatgccttatacaagaaaagagatggtattaagtaaatatatattatcattaggcggtgtaatatttatgtctgttttatatgaatttgtaaatattattatttattttataaattcaagttatgcaatgagtattgtagattcttttaatattatacttccattttgtcttatggcgataataataagttcaattaatctacctattaattttaaatttggtgctgaaaagggaagacttggaacgattttgatttgtgttattattggtgtaattggtggaggacttttttctcagtcatcaggcagtgttgaattaataaattattttatgaatataccttcttttgtgtatttagttttaatcgctcttttatggatagtatcatattttgtttcggttaaaatatatgaaaagagagctttataagagatactttggggtatctctttttttaatttaattaattttatgttataaatttatgtgagaagaatgatataatttttattaattaaaaataggagatttattatatgaaaaaatatattgccttattaagaggtgttaatgtaagcggaaaaaataaagtgccaatggcaatgttaagaaaatattttgaagaaattggttttgaagacgtaaaaacttatttgaatagtggtaatgtgatttttacaagtaatgaagatagcacaaaaaaagttagcgaacaaattgaggtaatgattaaaaatcaatttaatttggatattcctgttttagttttatcaaaagaagatcttgttgatattttacaaaatgtacctgaatggtgggggaatgataataaagagatttatgataatttaatttttattattccacctatgacttttgatgatgtttatgaaaagattggacagcctaagagaggattagaaaaaattcaaaattataaaaatgttattttttggtcttttgttcgtaaagattatcaaaagacaaactggtggtctaaaacagcaagtggagatattagcaaaaaactaactataaggacagcaaatactgttagaaaaattgttggtatttaatatgtttaattaagaaatatagataacatattttatataagttcattaaatttattagtattccaatatatttcttctatttcactataaaaatgtatttatataaaaaaattaaaaataatcaaataattttatattaattgtgagagtttactaaattttatgatatataacttttcttattcaagtttttcttattcaaatttttattattttaactaaaaatacaaataaaattcaattatatatcccccatttttcatcaaaaacgggtgtactcaagaaaaaataattatgctaaaatatatttaatagtaacttatgaaaaagtacaaaaaagaatgtttaaatatatcttatcttttattgattttaaggagaaaagtttgctgtcaatttttaaatagattttaggaataataattgactccaataaacgaacaataagcgacaaacattaatgatttacgttaaacatttgtcgttattatgaaaatatgataataacgtctattttataaaaagtctgtaattaaaaaaatattttataatcatgtaaagtatgcttttaaccgtggctttataaaataaactatttataatgtaaatgttaatgtaaatgttttaataacataaaaaataaatagttaaataaagaaggggggctgttttaattgaaaaaaaaatacatttggaaaagagtagaattaatttttttcactttagtttttatgctaacaattgtatttcaatttaatacaaatgtttatgcagctgaaagtccggatattactgagtttgcaacagttgagcagttgaggagttttaatactgatgatactgatggttcggttaatcctgctaaagtatattttgggaataataatcagcagtggtggatagcaggaagccaaagtaatgatagtataacattatttgctgcaagtatgatggaacaaggtgttgtgtttgaatctgaggtaacagactgggataagaaagactatgatccaaattggaactgtgaatatccagagggaagaaatattgaaaaagtcaatccaaatcattacggtgggagtcccataagaaacaagttagaaaatttattgacatcctattttacaaatgaagagcaaaaatttatgaaaagtacgaccatttatactttagatagttataatagtagagcatattctacaacagatatattgtatcttccatatggtaatcagaattttggtagagatcatataaatgtaggaacaaatggtacatactcagatgtattaaatacaggtcttcgtattgatataaattattgtggaactgaaattttctggttacgtgctccaagttctactttaccatataaatcaactgtaatgtatggatatgtttcttatgtatcggattgggctgttgaatacggatgtggattagctcctgcttttaaattagatttgtcatctgcactttttgcatcttgtgcaatgcctgcaacatctaatggcgccatgacattatctgatactgatggtgatggtgcctttacaattagatatcaaggaaatgtgggtactgcaacactcagcggagaatataaaagtgtttcagtaagtggtattacaaatgacaacacctatcttgttgtgcaaaatagtgaaggggcatgggcaaaaaaagtatctaataatgacttattgtttgcaagtgaaatttctgattctctgtcttcatttgaaaattgcaaggtttggttagaaacaacatcagatagaataacctatgcaaatttggcgagttataataaaagagatattaatgtaaaattcaaaactggagttagtatgaatattacatccaataatggttctcaaacaggtgtatggggtagtatcgagcctatcgaagttacagtaaatgacggctattatctaccggatgattatattgataaaattatggctttaaatgtattagaggcattacaaataacaaaaacagataatggctttatgattcaaggtactccaaatagtgacgtatatctttctttacctgaagcaactgcgtatattgatggaaatactattataaatcctccaactaatttaactgctgtttatggacaaaaactgtcggatattaatttaccggatggctggacatggtcagatgaagataccgcggtttctgtaggagaaaagacatatcttgctcgttttgatgtttcagcttatgaagatgaatatggctttgcaaatgtggaaggatataatgcacaagggcattatgtagaacgtaatttaacagttaatattgctaaagctgatagtaagattacaattaaaaaccagagtcttgataaagaatttgatggaaatgctgtaaatactcctgatatagataaaataggaagcagtaaagattatacaattagatggtttgaaaaagataataattcttggattcaaattgaatctgctcctattgacgcagggaattataaggttattgcaagtgtagaggctgatgataactatagtggtgcttctgatgagcttgaatttaacattagtaaattatcaaacgaatgggtagataatttatctattactggttggacatatggagagcaagggaatactcctaaagccgtttcaaaatatggtgctgttaagtttacatacagtgacaaaaaagacggtacatataaagaaacaattccaattaatgcaggaacatggtatgttaaggctgaagtagaagaaaataaaaattacatgggattagaagcaattaaattctttgaaattaaaaaagccgttcccaaatatgaagttccaaatcaaataactattgaaaaaggaaaatctctttcaactataaaacttcctgaaggtttttcatggaaagatgaaaatcagatagctgatagatcaggggtacatgcttttaaagccatttttataccatctgatactcaaaattatgaagttgtggaaacagatattatcgtaaatgttgttgaaaaaaatgtaccaccaagtgatacagataaaaccaataatactaatcaatctgatacatctgaaaaagtatcaacaagtgataatacaaatgtttttgtttggtatgcattacttatagtatctgtaattggaattttatcattagttttatttagtaaaagaaaacaacgttaaatagaaaaataatattttatattttaatagaaaataaatgtaaataaaatagttatattgtatatataaaactattgcaaatttaagatttaatataattgatacgaaaataaatactcctgtataaaacagtaattatgcaggagtatttttataaaaattaaaataattagcactcatctcttgacagtgctaacaaaaagtgatatattatacttgaacaaagaggagaacctcagaaagattcaaaccccatagttcaaaaaaactagtgacatagatagaatgtctaagaaaaggaggaatgacttatgatgttacctagtatttttggagaaaacttatttgatgatttaatggacttgtctttggatagagatttctttggtggtaaaaatccactatacaaacaagaaacaaatttaatgaaaactgatgttaaagaaaatgaagataattatgaagtagatattgacttacctggatttagtaaagatgaaatttcagctcatttgaaagatggttatttaacagtaagcgcaagcaaagatgtaaataatgatgaaaaagacgaaaacggaaaatatataagaaaagaacgttatagtggttcttgttcaagaagtttttatataggaactgaaattaaagaagatgaaattaaagctaaatacgaaaatggtattttgaaattaaatgttcctaagaaagatcaaaaacaagttgaagaaaagaaaactatagcgattgaaggttaattgaaaagggctaccgtttaggtagccttatttttttgtaaaagatgtaatgccgaagcatattattgctatgctgagtaatataatactatcatttgctgatatttcttttaatatgtttaaaacaagaacgcctattccaagggctaaccctacgcattttgctgttaagttaatcatttctgaaaagtctgatttgtttaagtttttaaaatctaactttttttgctctaaacctaaaaaatcatttgtatccatatcaagaatttcgcaaaggagaggtattattgaaatgtcaggatatgataaattcctttcccactttgacacagctttatctgtaatatttaatttttttgcaagttcttgctgtgtcatgtttttttcttttcttttttgttttattttttcacctatatttgaattcatatttttctccttgaccaattattatagatatattttaattcattataaataaatagtctatctacttataagagaaaaaggtaaaccgacagtttacataaaaaaagacaaaatataatttatattttgtcttttaatttattattattcccaaatcttatcttgttctcttctaagtttaacaagtaaagaatcttcatccaagatgacatcatcataagttataatttcaccttttttaacatcttttgccatttttgtgtttttatttataagacctattggaagtgcatttagttcttttgcaacttctcttttatcaattgttccgtaagtagaaaaacctcctataccatctactgattctccttttttaagatctttttttgcaactgttatagcttcacatacaagaccatccataggaacgattgttggtgctttatctaaaactgctcttgctattgtaagtggtgtttccattccgcataagtgataaggtctgtataatacgtaatttggaccatctccgattcttaagtattgcatttcatgatgtataaactcaagatctgatgaaactattacaaatacaccaggggcaataccatttacccattctacaacaccgtaattgtttaaaataccgccttcttcttttaaacaaagaactttatctaagtttttaatgtcacattttgggccatgtccacctctaacatctggaacaagtcctgtagagtttgccatacagcaaagttcaaccatgttttttgttccgtcagagaaagaacattgcattttagggcttacgcctctgcttattgcataatctcttatactgtcaggtgtgcagctgtgatcaacttcattattttttccttttcctattacttttatatcaaagcccaaagcttcactaaagtcaaacatttctttaactgctccgggttcgtctcctgcacttcctgtataaattacacctgctttgtcagcttttctttttaaaataggaccaacaacaacatctgcttcaacatcaagcattacaatgtttttgccattgtttattgtatcaattgcaatttctgctccaatatcagtaaaacctgttgcatcaacaacgcagtctgttgcttcaacaaaagaagcaatttgtttatcttcacttactacaattttaccttttttgatagcatcatttgcttgtgataaattgtttgtaatgacataatcattttctgtaatatttgattttgaaaatgcatgtaaaactttatttacgtctatgtcacatacaacgcttggtgtcattcctttcattttgtataactggcttattaaacctcttcccatttgtccggcacctattatgccgactttaataggattatttttttcatgtaaatcttttaatctgtaattcatgcctagcatagataattttcctcttttcttttgtattaaatatgttcatcccctcaaatgtacatattttaagcagaacaattatagcactataatatttaaaattatatatttttaattaaattctaattttaatttgacaagtatatacaaacttcttttttattaagttttattattttctaaaaggaaaaggtgaacaagtgttaagtggattagttaaaaataaagggttaattttaatatgtttattaatttttaatttttcgattccttttggtataaagagtcaaatagaggagaagactaacggtacggctgtttttaaagacattataaaaaaaagtgttgtagtgatgaatgatgattcaaatagtaataagaaaacaggtagtatttatggttttacaaaaaatattttctctcttactattccttgtttggctttgaatgatgtaggttatgaagaggtcgaagtaggtaaagataaagaagaagcattaaatagtagcgagcttaaaattgcaaataaaaaaatgaatgatgataaaaccgtaagtaaagttaatgatgggaaacctcttgttttaatatatcatactcatgcaactgaatcttttaaagacaaaacttcaaaaggaacttatcgttcaagagaaaatgacgaaaatatggtaagtgtaggagaggaaatggcagaagttttagaaaaagaatatggtattatttgtattcatgatacttctttacatgattatccaagttataatgcagcatacgataattctcttgagagtgcagagaaaatattaaaagaaaatccaagtataaaatacgtttttgatatacatagagatggacttccttcttcaaataataatgaaaaatataatggaaaagttggaagtaagtctgctgcaaaagttatgactgttcttgggatgaatcataaaaattctagtaaaaatttaagttttgcaaataaaataaataaacagtttagcagtatgtatcctgatattaatcttggaataataaaaagagaaccatatagatacaatcagtggcttagtccaaacagtctgctttttgaaatagggagtaatttaaataatttggaagaagcaaaatattccgcaaagcttcttggaagagtagttggagaggttataaaagaggatatgaaataatatgtataaacgaaatatttcttttaaaacaatgattttttttcttgttttgataattatagcaggaatatatatgttcttttatctgaaaaatatgtattatgatagttttaaagaacatgaaacaagtgtttttcttgatcaaaacagcgctgaagatagcaataatgaaagtaatattattaatatttttggatatgaattaaatattgatgactttaagattttcacaaaataggattgtgggaatctttttttattttaaatttaaattaaatttggttgacataaactttatatatcagtataattatactgataaaaaattactgatataaggaggaaaatcatataaaatggataggaattctgtttcaaaacaagctctccaacgattaccttcttatttaaattatcttaattgggcaaagagagaaaatataaaaaatatatcttctccgacaattgcaaatgatttgagattaaacgaagttcaagtcagaaaagatttggcggcaataagctctacaggaggaaaaccaagacttggatatgatgttgatacgttaataggagatataaaaaattttctgggttatgacgaaactgataaagccgtattaataggagcaggacagcttggtagagcccttctttcttataatggatatgcagattatggtcttgaaattgttgcagcttttgatgtaaataaggacattatcggtaaaaggtttaaagggaaaccgatttatcatgtaaacaagctatatgatatatgcaaaaaaaataatattcatatcggaattataaccgtatcggcaaatgaagcccaagatgtatgtgatatgcttgtcgaatgcgggattttagctatatggaactttgctccatctcacttggtagttcctgataatatccttgttcaacatgaaaatacagctgcctcactagccttgttatctattcacttgcgtgaaaaaatggataaagataaataaataatattgtaaagtttttgatattattatataatcaaaatataaataaaacctttatttataggggtttaaataattaagtttataaaagtttggtaatatataccggcttatatataagttcatagctttgccttttgctatgattaaagttttaaatttaggaggaaaaaaaatggcaaataaagtagttatagcaggtgcttgtcgtactgcaatcggtacaatgggcggtacattaagcactacacctgctgcaaaattaggttcaatcgtaataaaagaagctttaaagagagctaatgttccggctgatcaagttgatcaagtatatatgggttgtgttatccaagctggcttaggtcaaaacgtagcaagacaagcttcaatcaatgctggtttaccaattgaagttccagctgttactgtaaacgtagtttgcggttctggtcttaactgtgtaaacatggctgcacaaatgattaaagcaggggatgctgatatcgttgttgcaggtggtatggaaaacatgtcaatggctccatatgcagtaatgaatggtcgttatggttacagaatgaacaatggtactttagttgatacaatggtaaatgatgctttatgggatgcatttaaccaatatcatatgggtattacagctgaaaacattgcagaacaatggaatttatcaagagaagaattagacgaatttgctgctaattctcaacaaaaagctgtagctgctcaagaagcaggtgcttttgatgatgaaatcgtacctgtagaagttaaaaagaaaaaagaaacaattatcttcaacaaagacgaaggtcctcgtcctggaacaacagctgaaggtattgcaagacttcgtcctgcattcaaaccagacggtgttgtaacagctggtaacgcttcaggtatcaatgacggtgctgctgctgttgttgtaatgagcgaagaaaaagctaaagaacttggtgttaaaccaatggctacatgggtagcaggtgctttaggtggtgttgatcctacaatcatgggtatcggtcctgttgctgctacaaagaaagttttagctaaaactggtatgagtgttgatgatttcgatattatcgaagcaaacgaagctttcgcttctcaatcaatcgctgttggtaaagaattaggatttgacttaaataaattaaatccaaacggtggtgctatcgctcttggtcacccagtaggtgcttcaggttgtcgtatccttgtaacactattacatgaaatgcaaaaagctgatgctaaaaaaggtttagcaacactttgtatcggtggtggtatgggttgtgctactatcgttgaaagagactaatttattgattaaattaaggagattataaaaatgggttttgttagatatgaacaagatggttttgtaggaatagttactattgaccgtccaaaagctttaaatgctttaaacgaagaagttttaaaagatttagaagctacttttgatgctattgatttagataacacaagagcagttatcgtaacaggtgaaggtaaatctttcgtagcaggtgctgatattgcatctatgagcacaatgactgctgaagaaggtgaagcattcggtaaattcggtaatgacatcttcagaaaaattgaaactttcccaattcctgtaatcgctgctattaacggttttgctttaggtggcggaaacgaacttgctatgagttgtgatatcagaatttgttctgataaagcattatttggtcaacctgaagtaggacttggtattactcctggatttggcggaacacaaagacttgcaagaattatcggcgttggcatggctaaagaattagtatatgctggatacaacattaaagccgataaagctttggaaatcggccttgtaaatgctgtttatgctcctgaagaattaatggaacaagctaaaaaattagcaggtaaaattgctaaacaagctcctattgctgtaagaaattgtaaaaaagcaatgaacgaaggtttacaagtagatatggatcaagctatcgtaatcgaagaaaaattattcggagattgcttcaatagtgaagaccaaaaagcaggcatgaaagcattcttagaaaaaggaaaagctgaattccaaaacaaatagtgttttaatttaagtaaatatagtccggatttttccggacttaaaaaaataatttggaggataataatgaaagtaggtattattggtgctggagctatgggttctggtatagctcaagcttttgcacaaacagaaggttatgaagtttgtttatgtgatatcaatgaagaattcgctgcaaacggtaaaaaaagaattgaagcaggatttgctaaaagagtagcaaaaggcaaaatggaacaagctaaagctgatgaaattttagctaaaattacaacaggtgttaaagatatctgtggtgactgcgatttaatcgtagaagctgttcttgaagttatgtctatcaaacaagaaacattccaagaattagataaaatttgtaaagaagattgtatctttgctacaaacacttcttctttatcagttacagaaatcggtgctaaagtaaacagaccacttatcggtatgcatttctttaacccagctcctgtaatgaaattagtagaagttatcgcaggtttaaatactcctgtagaaattgtagacaaaattaaagcaatttctaaagaaatcggtaaaactccagtagaagttgctgaagctccaggattcgttgtaaacagaattttaattccaatgattaacgaagctgttgctatttatgcagaaggcgttgccagcgttgaaggtatcgacgcagctatgaaacttggtgctaaccacccaatgggacctttagcattaggtgacttaatcggtcttgacgtttgtttagctattatgaacgttttatatgacgaaactggcgaccctaaatatcgtccacacacattacttaagaaaatggttcgtggcggcaagttaggtcaaaaatctggtcacggattttatgattataaataggaggattcaaaacaaatggattttacattaagtaaagagcatgaaatggcgagatctctattcagagaatttgctgaaacagaagtaaaacctctagctcaagaggtagatgaaacagaagtattcccaagagaaactgttgaaaaaatgcaaaaattaggattcttaggaattcctatgccaaaagaatacggcggacaaggttgtgattctttaacatatgcaatctgtgttgaagaattatctagagtatgtggtacaacaggcgttatcgtttctgcacatacatctttaggtgctgaaccaattaaaaaattcggtacaccagaacaaaaagaaaaattcttaagaccacttatcagtggtgaaaaacttggtgcttttggtttaacagaaccaaacgctggtacagatgcttcaggtcaacaaacaaaagctgttttagacggagatgaatatgtacttaacggttctaaaatctttatcacaaacggtaaagaagctgatacatatgtaatctttgctatgacagataaatcaaaaggaaatcacggtatttctgcattcatcgtagaaaaaggaacacctggatttacatttggtactaaagaaaagaaaatgggtatcagaggttcttctacatatgaattaatctttacagactgcagaattccaaaagaaaatcttcttggtcaagaaggtaagggatttgctattgctatgcaaacacttgatggcggtagaattggtatcgcttctcaagctcttggtttagctcaaggtgctttagattctacaattgaattcgttaaagaaagaaaacaattcggtagacctatcgctaaattccaaaatactcaattccaacttgctgatatggcaacaaaagttgaagctgctagattattagtttacaaagctgcaagagctaaagataatcaaaagagattctctttcgaagctgctcaagctaaattatatgctgcagaagttgctatggaagttacaacaaaagctgttcaacttcacggtggatatggttacacaagagaatatgatgttgaacgtatgatgagagatgctaagattactgaaatttacgaaggaacttcagaagttcaaagaatggtaatctcaggtaacttattaaaataataggaaaaggagataattatagtgaaaatcgtagtttgcgctaagcaagttccagatacaaacgaagttagaatagatcaaaaaacaggtactctaatcagagaaggcgtacctgctattatgaacccagacgataaagctggtctagaagctgcacttcaaattaaagataaaacaggtgcagaagtaactgttataacaatgggtttaccagctgcagaagaaattttaagagaagctatggctatgggtgctgataaaggtgtattagtaacagatagaccattcggtggtgctgatactcttgcaacatctaatacattagctgctgctttaaaaacaatggaatatgacctaatcatcacaggtagacaagctatcgatggtgatacagctcaagtaggtcctcaaattgctgaacatttaggaattccaaacatttcttatgttcaaaaagttgttgaagtaacagatgatagcatcactgttgaaagacaatatgatgatggttatcatgtagaaaaagctcaaatgccttgcctaatcacagctcttggcgatttaaacaaaccaagatatatgacaccgggcggaatctttgatgcatttaaagaagacatccaaattattacaagaaaagatgttgatatcgctgatgaaaaaatcggtaaagctggttctcctacaaatgttgctaaatcattccctaaacctgttaaagctgcaggtgaaaaagttgaattagatgctgatgcttcagctgattacattttaggaaaattaaaagaaaaacatattatctaattaattaggaaaggaaattgaaataatgagttttgaagaatataaaggcgtatttgtcttcgcacaacaagttgatggtgttatcaacaatgttgcgcttgaattaacaagtgaagctacaaagcttgctgctgctttaaacacagaagttacagctgttcttttaggaaaagatgtaaaaggattagctgatgaattagcagcttatggtgctaatagagttttagttgtagatgatcctgcattagaaacatatacaacagaaccatatgcacatgctatggatgaaattattaaacaatataaaccagatatcgttctttacggtgctactgcaatcggtagagatttagctcctagagtttctgcaagagttgctacaggtcttacagctgactgtacagttcttgaaatcggtgaatttaaaaatgctttaggtaacgtaaacaaaggttatgaaggtaaaatgttcttaaacgcaacaagacctgcatttggtggtaacttaatggctacaatcgtatgtcctgacaacaaacctcaaatggctacagtaagacctggcgttatgcaaaaaattgaacctaaagaaggtgctaaagctaacgtagaagaagttaaagttgactttactaaaaacaacaaatatgtagaagtactagatgttgttaaagctgtaaaagacaaagttgatatttctgaagctaaaatcttagtatcaggtggtcgtggtgtaggtagtgctgaaaacttcaaattattagaagatttagctgatgctatcggtggtgaagtttctgcttcaagagcttgcgttgacgctggttgggttccaaaagatatccaagtaggtcaaacaggtaaaactgttcgtccacaagtttactttgctattggtatttcaggtgctatccaacatgctgctggtatggaagaatctgatattatcattgcaatcaacaaagatgaatctgctccaatcttcagcattgctgattatggtgtagtaggcgatttaaacaaaatcgttccattattaacagaagctattaagaatgcttaatataatcataaaatctaactagtaaaaaggagtgtattattacactcctttttttatgaataaaaccacgtaatatatacgtggtttttatttagttattaaatttttctttaaatctgttttcgtattcaataatcagttcttctctaaattgaggagcagcaatattgataagattttttgctcttgttcttaatgtttcaccttttaaatgggcaatcccatattcggtgacaatataatctacatcggttcttgatgtagttacagcacttcctttttgaagaaacggaacaatttttgaaattgtgccgtttctcgcggttgcaggaaatgcaattatggattttccgccttttgaaaaagcagaacctcttacaaagtcaacctgtcctccaattccgctaaactgttttaatcctattgcttcagcacaaacttgtcccattaaatcaacttctaatgctgagttgatagaaatcatattatcattttgtcctattaccactggattatttacatattcaatatccatcatacttacaatagggttatcgtgaacaaaatcatataatttttgagtccccattaaaaacgcaacaaccattttattcttatgtaaagttttctttttacatgttattacacctttttcgtataagtcaactacgccatcagaaatcatttctgaatgtatgcctaaatcctttttatttgtaagaaattttaacactgcatcaggaatagcacctatgccaagttgaagtgtatctccgtcattaattaattttgcacaattttctcctattttcatttcaacatctgttattttaggatttggaagttctggaatttgctcatcgtgttcaactaagatgtcaatatcattaatatgcaagaaattatctcctaaagttcttggcatttttttgtttacttgtgcaattgttaattttgcggcttgtgttgttggttttgtgtagtcacatgatgtcccaagggaacaaaatccatctttatcaggaggagaaacagtaactaaagcaacatcaacaggtagggaagatctgaaaagagtaggaatttgataaaagaagcatggtgtgaaatctcctcttccttcataaacagcatctcttgtattccctccaagaaagaaagcatttaatttaaagtgttctttcatttcttcttttgcataaagagaatgtcccataggaacaagttgaacaatttcaacattcttatatgctttataattttctaccattttatctacaatataaataggttctcctaccgcatgggcaataactactctatcgtttgattttatataatttacagcttcctcagcggtctttaatttacttttatatagtttatttatatccatcttttactcctttcctcttattttgattaaggtaaaagaaaaatataagttattcttttatatttgcaatattttttgcaagttcttttttcatatttaaattaccttgtcttgctatcatgattctttgagcttgaggtgagcctgctccgtgtagggattctgttctgtaacctactgctgctgttccaagtgttagattttctataagtcttaaaatttttagtctgtcttttgtaggtatattagctacaccttttaaatatttttctacgtattttcctacaacaggactttctaaatctttttgtgaaggagctgtaaccattattcctcctgcaatgtcttctgcaagtcttgcaatttcataaggatatcttgttacgttttgtttacatacatttgcaagaagtaaatcaatcatataattaccggacattgttttatatccttgagaagaacaagctataccacagctgtataaagtttcatttaggtgtgtcatttcaattaatttatcttttatgtgagaagcttttgctgctccgttatattctgcaaccactgctgctgcacctataagaacatctcctacaccaactttacatcctccgtaagattgtctgtgataacctgcaaatctttcaacaagcattcctgaaaaatcatattctccatttaaaaatattctttcatttggaacaaaaacattatcaaaaataacaagagcttccattcctccaaattctgcatttcctacatccatatcagaatcttcaagttttctggtgtcacaagattgtctgcctacaatcattaaaataccttcagtatctgttggaaccgcaaaggaaatagcatagtctttgtcttgttctgtcatatttatcgtaggcataaccaaaacttcatgagagttaaccattcctgtttgatgcgcttttgcacctcttacaataactccgtcttctcttctttcaacgactcttaaatataaatctggatcttcttgtttagaaggaggaagtcctctgtctcccttagggtctgtcattgcaccgtcaataacgaggtcattgtcttggcaatatcttaagaactttttaaagttttcatgataatttgttccatgtgctttatctgtttcgtaagttgtactatatactgcattgaatgcatccattcctacacatctttggaagcatgatgctgttttttgtccgcatagtctttgcattttgacttttttaattaaatcatctgtgctttgatgaatatgtgtaaatctatttatttttctgccgtcttctaatgttactgtcattaaatcttcgtattccggcatttgtgctaaatcatatgtagctcttactgaattcaatgaaggtcgtaaaattggattatctactggattttcaattttttctccaaacatatatacttgtaaatttaattttcgtatactttcgatatattctttacctgtcattaaagccataatatataccttcctttcgaatgttttatgttagggtagttgggttttataatatataatgcaaattgcatgccaacaatttttactgtaaaaaggctatgtttaaacaaaaagtatatttttgttgcaaaaatgcaatgcaaaaatacaaaaaaaaaaggcgctgggccttttaatttgcaggtgagaattttatttccgttgaaagattgtctactgtatcaaaggtatatccttgtttttttagttgttttattacattgtcaagcccgtttggcaaacttttatttctgtcaaatacatgaattaaaacaactgtttcttcattccattttgcttgttttattataatactatattgttttgttgaaacttttgatattgtatcattagggaatgcattccaatctacataatcatatccgtattcttttgacagttttattatatttttgattacttttttccctccataagagaatgatactgtattgtttgttcctccaggaaatctaaaaattctacaatcatatcctgttatgtctttaaagttttttctgtttttttctaaatcttcaataaaagctttgggatttttataaatttttttgtaatcatgagaataagtgtgtagagcaagaaggtgtccgtcgtttactatttctttaattattttttcatcttctttaccttttgcagcattaaagaaaaaggtcgcttttacatcatttttctctaatacgtctaatacttcctttgtcatttgtgtagggccgtcatcaaatgttaaataaattttttttaactttattttttgtatgctgtcgctattaatgctacctattgttaatatatgaaaagggatgtttttcattttagaaaatgtttttgatagtgatattctttttgtatttgcaaaagctattatttttttatcattattactttttattattttgattttattacctttatctataaatcctatgcattcatttctctcgtttgttaatatactttcttttacaataatatagtttgaatttttatttctttcataatttataggattagaagaacttttgcttattgaagttatttcatttttattttgtaaaattttgcatactttgttataattattactatacgatatatttaaaatccacaaaatgaaaaggacatatataataataaaaaaatatattaaattgttttttttcgttagttttattaataaatttttcatacttgtattattatatcaaaaaataaaataaataaaatattaaaattataaaagtatagaggggaaaatatttatgattaaagcagcaatatttgatttagacggaacaataatagatactcttgaagatttggcaaatgcaggtaactatgtgttaaaacaaaacggatttgaagtgcatgataaagaaaaatacagattttttgttggaagcggaataagaaatttatgtataagaatattacctgaggaaaagaaaaacgatgaagaattaataactaaaatatttaatgaatttaatgcatattatggtaaacattatatggataatacaaaggcatatgagggtgttgaaaatatgcttaataagcttattgaaatgaatataaaagtaggcgttcttacaaataaaggtcatgaatttactgttcctatgctaaaaaaagtttatggagatttcccatttagtgtgattttaggtaagactgataaattcccagttaaaccaagcaaagaatgtattgattatgtaatgaataaattagaagtaagtggtgaagaatgcatttatattggagacagcaatgttgatatgcaaacagcaataaacggaaatattagtgaaataattggtgtaagctggggctttagacctgttgaagaacttaaacaagccggggcaaaatatattgtagatagcccagaagaaattattgatatagtaaataaattaaataattaataatataaaaggagaagaaatatgataaaagcagcagtatttgattttgatggaacgttaatggatactttggtggatactgcaaacagtattaatcatgtattaaaagctcatggattcgatgaagttccaattgaacaatataaggatgtatttggaggaagctgttatgatatgataaacatggttactccaaaatcaatgaacgacccacaacttttacatgaaatggatgttgaagtacaatactattattcaaaacattttaatgaaaattgtaagccttataaaaatataagacatgcattaagaggacttagaaaaaagaatatagacttatgtgttataacaaataagccttcaagattattggttcctttattaaacgaattttttgaagatattgaatttaaacatattatagcagcagattcaggatttcctttaaaaccaaatcctgcatcttgtaatcaattgatgcaaacacttgatattcatcatgatgaagttgtgtttataggagacagcgaagttgatatccaaattgcaaaaaatgcgagagcattttctattggttgtggttggggattcagaggtggtgaatcattgattaaggctggtgccgactatgttattcatgaacctatgcatgtattggaagtagtaaatattcttaataagagaagtcttaaaaatattatggatgaagctaaattgatactaaaaatattaaaatagtttttaatttgataatttttaaaggttattttaagaattgtaattataatgattattaattgataattagtattaattaccgagatttataaaaatataatattttttacaagggtgtaatttttataattggcacccttttagtttggagagatatatataataaaattttattatacactaaaatttattttataaataatgcaatatatttgattataaattgtatgtaaatgaaaaaattaatgatataatttagaaaaatgtcttaggaatattatggaaacaaaaatatatgatttaacaaataatgacaatttaacagatatttttaatgaagccgccagagtaataaataacggaggaaccgttgttttcccaacggaaacagtatatggtcttggagcaaatgcttacgatgatgaagctgttaaaaagatttttaaagcaaaaaacagacctatggataatccattaatagtccatattagtgattttggtatgcttgagggattagttagagaagtaagcaatgatgcaaaaaaactaatggataaatttttcccgggtcctcttactttaattatgaaaaaatcagataatattccaaacagcgtatcaaataacttggatacagtcggaataagaatgccaagtgacaaagaagcaaatgcttttataaaagcttgtaatactccgatagcagcaccaagtgcaaatatatcaaaaagaccaagtataactaataaaaaatatttggtagaggaacttagtggtaaagtagatatgattctatgttcaaaggaatctcaaataggtttggaatctacggttttagatgtttcgactgataaagtaaaattacttagaccgggaaaaataagtgcaaaagaaattgaagaggtaataaacaaaaaagtttatggatacagcaaagaagatgcacttcttccaaaatctccgggaatgaaatatgaacattataaacctaaaacaaaggtggttgttttaagcggtgaagataaatctattattaattatctaaataatttaaaagaagaacatataggatttttaggattaaataatattttaggtaaaattgaaaatgataaagtattcctaaaatctttgggaaaagatattgttgatgcaagcaaaaatttatattttcttttaagggaaatggataaagaaaatttaaatgtgatttatgctcaagctatggatacggaaggtatagggcttgcgtatatgaatagacttcttaagtctgcatccggagatataataaatctataaatagttaataactgctttgcagtttaaataaattaattttaaaggagaaaaattatgaaaatagttattgcaagtgatcatggtggttatgaattaaaacaattcttaatcgacacatttaaaaaggaaggttatgattttgtagattacggaacagattctgcagatagtgttgactatcctgactatgcaattaaagttggcgaagctgttgcagcaggagaatttgatagaggtattttaatttgtggtacaggtattggtatcagcattgctgctaataaagtaaaaggtatcagagctgctcattgtacagatacattctctgctaaaatgtgtaaacaacacaacaatgcaaacatcattgtattaggcggaagaattacaggtcctgaacttgctgctgaaatccttagagcttatttagatgaaaaagaatttttaggcggaagacacgaaaacagaattaacaaaattaaagcatacgaagaaaaagtatacaaataataaaaggaaaaaataatggaaaataatcaaagaccttcgtgggatgaatattttatggatatgttggaagttgtaaaaactcgttcaacttgtataagaagacaagttggagcaataatagtaaaagaccataaaattatttctaccggttataacggagctccaaaaggtcttaagcattgtacaaaagatacttgcataagacttaaaaacaatataaaaagcggagaaagacatgagctttgcagggctacccatgcagaacaaaatgctattatttctgcggcaaccatgggagtaagtgtggaaggagcagatatttatataactgattctccttgtattctctgttcaaaaatgttaataaatgcaggtattaaaagaattgtatataaaggtaattatcctgatgaatttagtatggaattattaaaggaagcaggagttgaggttgttaaatatgacggaaaataataaaaataatgatatctcaagtattgcaaaagctttggcgatattttttcagctgggcattactattgttgtaacaatagttttatgtttgttttttggaaaattcttagatacaaagtttcaaacgggtaatatttggacgttaatatttttatttcttggtatattggcagccattaggaatatgtattatattcttaaaaatgtaatgaaaaaataaaaaaatatggtggtttgcttttgcaaaccaccatataagcaatacgaataataatgaatgaggcttaaaatgaataaggaaaataacgagaattttaccattgaagatttactaaaagagcaaattcaaataagtatatttactttgattttaaattttatttttataatttttgtattgctttttaaattagataagagtataattcttggaataatatcaggatgtcttgttgctttaatatttcattggatgttattcaatgatttaagaacggcaataaagatggataaggacagtgccgtaaattatgccaatttacatgctgccataagaaaagtactcttgatattggtattagtttttcttgttgctaataagtggataaaagtaaatgtaataggactaataatagggttattatcttttagagccgtgttatatgtttataatcttattagtttaaaaaacaagtaataaaaaaatggagaagagaaaatgaatgtaagtattagtactgttgataatatttttaatatcggcaaaatacctatatctaatacaattatttggactgtaattattttagctttaaccttcgtttttttaatgtatttagcaaaaggtcttgaaattagacctaattctaaaaaacaagttattgctgaatatatggtaagtgcttgcagagattttgtaagcagtactatgggtaagaaaaacattggttttacaccatacttttttgccttggctgctttcttgcttgttgcaaacttaagtagttttgtattccttgggatagtaagacctcctactgcggatttggctacaacacttacacttggaattataacttttgtattaactcaatattatggattaaaaacaaaaggtataaaaaaatacttgaaggattttacagaaccggtatttttctttttacctataaatattattggtgaaatcgcaaatcctgtttcacttggtttccgtttattcggtaacattacaggtggacttataatattatcattggtatattctatatttgtcggttccgcaaaagttgcaatgtttgttttctttacatcattgattttatgtctatacttatgttttgggaaagcaaacaaatttacggaaaataagattgttagaattgttgccatattattacttataccatcattctttgtagcattctgtcacggttattttgactggtttgccggaatacttcaaacatttatattctgtatgttatcgatggtattcatttcatccgcaatggatgaagaataatttgcctttacccgatttttaatcggataaaatataaaaatagaaaaatgcttttttattcaaggaggaaataataatgaatatttcaggaagtgatttaattttagcatgttcagcaataggtgccggtcttgccatgataggtgcattaggtacaggggttggacaaggtaatgcaacaggtaaagcttgtgaatcagttgcaagacaaccagaagcagaaggaacaatattaaaaacattattaacaggttgtgctgttgcggaaacatcagctatttattgtttggttgtcgctttaattttattatttgttaaaccttttagctaaaaaagacaacgataataaaggtaaggtggtgattatatgctagctggatcattaataaacttttcaactgaaatgctttatcaaatgttaattcagggtgcaatatttttactattctttattttggtaaagaaattcttttatgataaagtcgtagatgttattgataaaagacaaagtattataaccgaagaatttgacaaagcggaaaatgaaaatttaaaagcaaacgctttaaaacaagaatatgaaaagaaagtaaaaagtatcaatgaagaagctttagctattactaacgaggctaccaaagaagctaaagaaataaaagaaaatattatttctcaggcaaatgaggaagctagaaagattaaagctaaatctaaaaaagatattgaaagtgcaagagaacttgcaatgaaagaaatgaaagataatattattgatatttctttagatataacgaataaagttatagatgcaaaacttgataaagatgctgatgaagcattgattaaaaaagctattgcaagtttggatgaggtgcattatgagtaatgctgcttacagatatgcttattctttatcatctttatgtatagaagaaaacataatagatactgtatatgataaatttacatcattttatgattcattattaagtaacgaagaactttataacgttctttcaaacgaaacaataatgaaagaagataaaaaaagtatcattaacaatattcttagtgatgaagataataaaatacttaaaaacttttttaatattttagttgataaggataggatttgcgaaatcaaaatgatatatcttaattttaagaaaatgtacttagaatataaaggtattttagatgttgaggttgtaagtgcaaatccgttaagtgatgaattaaaagaaagtttaaaaaataagttatcaaaaaaacttgataaaacaattatcttaaatgaaaaaatagataaagatatcattgggggtatcgtactatttattaatggaaaaatgattgatttatcagtaaaaaatgaacttaatcaaataaaaagacagttaaaagaaacaaagatagtttaagaagggaaataaaaatgaatttaaaacccgaagaaatcagtagaattataaaagaccaaattaaaaactatgaccaaaaaatagaaactacttcagtaggtactatcttaagtgttggtgatggtatcgccagagttcatggtttagatggcgcaatgatgggtgaacttattttgttccctggtgatgtttatggtatggttttaaaccttgaagaagacaatgttggttgtgttctgcttggtgatgatacaaatatcgtagagggagacactgtaaaatgtacaggtaaaattatgagtgtacctgtaggagaaggtgttatcggaagagttgtaaatgctcttggtgaacctattgacggtaaaggaaatatcatagctgaagaatacagaagagccgatgtaaaagccagcggtgtaattgaaagaaaaaaagtaagtgtaccgctacaaacaggttataaagccattgactctttaattccaatcggaagaggacaaagagaacttatcattggtgatagacaaacaggtaaaactgctttagcagttgatacaattttaaatcaaaaagatgaagacgtaatttgtgtatatgttgctatcggacaaaaagcaagtacagtagcgcaaattgtaggaacacttgaagaatacggtgcaatggattatacaacagtagtatgtgccacagccagtgaaatggcaccgcttcaatatctttctccttattcaggatgtgcaattgcagaatattttatggataaaggaaaagatgtattaatagtttacgatgatttaagtaaacatgcggtggcttatcgttcaatgacattactacttcgtagaccacctggaagggaagcttatccaggggatgtattctatttgcattcaagacttttggaaagagctgcaagacttgaaaaaggcggttcaataactgctcttcctattattgaaacacaagcaggggatatttcagcatatattccaactaacgtaatttcaattacagacggacaaatattccttgaaagtgaacttttccatgccggtgtaagacctgctgtaaaccctggtatttcagtttcaagggttgggggagatgcacaaattacaacaatgaaaaaagttggcggacctcttagaatagagtatgcacaatacagagaacttgcttcattcgcacaattcggttctgatcttgataagtcaacaaaggcaagtcttgaaaaagggaagagaattgttgaaatgttaaagcaagagcaatattctcctatgaaagtagaagaacaaatacttgttatttatgctattacaaataactttgcaagagatgttaaagttgatgatatcaaagactttgaaaaaggattagttgaatatgcacatacaaatgcagctagtactttagaaaaattaaaagttgcaaaaggatttgatgatcaattaactgaagaattgacaaaattaattaacgactataaagatatttttctaactggtcgaatataaaggagctatgagttatggctgaaaatatggcagacattaaaagaagaataaaaagtgtgtcaagtacaaagcaaataactaaagcaatggaacttgttgcaagttcaaaacttagaaaagcaaaagaaagagctataagcagaagtcattatacagatgcaacatatcaacttcttcttagaatagcaaaatatacttctcacataaacaatttatattttaatgtaagagatgatgctcataaaataatatatattgttttaagcggtgataaagggcttgccggcggttttaactctaatgttattaaagaaactgtaagtcaaataggcgataaaaaagaagatgcatatatttttgcacttggtgcaaagggtgccgactattttaagaaaaacggatatgatgtagtaggtgaatatattggaataagcgatgaccctaactacggtgttgctaaaaagattatcggtacagtaattaatctttacagcagcaataaagatgtcagaggggtaagaatgatttattctaaattcaactctgttgtatctcaaggtgtattaagtgcaaaagttcttcctatttcaagaaaagcgaagaacagcgacggcagtgatgttaaaagtgaattagtcatagagccgggtggagaggaattattggaagaattagttcctcaatatataacaagtcttctttatggtgccatgattgaaaatcatgctggtgaagaagcatcaagaagaatggcaatgagtgcagctacagacaatgcaaacgagcttttagatgaacttgaaataagatacaattcagccagacagtcaagtattacaaatgaacttatagaaatagtttcaggtgcagaagccttgaagtaaaggagaagaacaatgaatgatgaaaatttacatttagaaattgcaactcctacaaggactttttataaagattatgtagagaaatttacttttagagctacaagcggagaaatgacagtgctgcgtaatcacgtgcctacaatgactgttgctgatattggaataatgcatataacaaatttagaaggtgaaaggcaagaggcgacattgtttggaggaactgttttaatagaaaacaataaaatccttgttgtaacagacgatgctttatggcctgaagaagttgacgtaaaaagagctgaagaagctagaagaagagctgaagaaaaacttcattcaagcaaatataaccgtcaagaatttgttcatgcagaacataagttaaagaaagctttagtaagaatagatttagcaaatacgtatgaaggtatttctagacataagaaatattagtcacatgaattaaaggagacaaaaaagtcctatggaaaatataaaaggaaaaatagtccaagttgtaggaccggttgttgatgttcagtttaacgacggagaattacctaaattaaacgaagctattaaaatagataatcacggtgaagaattaatcatagaagttagcgaacatatcggggacaatacagtaagatgtattgctatggatacaactgacgggctaattagaggaatggaagctactgctaccggtaatcctattatggttccggtaggagaaaaaacattaggcagaatggttaatgttttaggacaaccaatagatggaaaagaaatggatatggatggagttaaactttctccaattcatagagatccaccatcttttgaacaacaacaaactgttcctgaagtatttgaaacaggaattaaagttgtagacttaatttgtccttacacaaagggtggtaaaatcggtttattcggtggtgccggagttggtaaaactgtattaatccaagaacttatcagtaatattgccacagaacatggtggtctttctgtttttgccggtgtaggtgaaagaacaagagaaggaaacgacctatattatgaaatgaaagattcaggagttttagaaaaaacttcattatgctttggtcagatgaatgagcctcctggagcaagaatgagagttgctttaacagggcttactatggcagaatattttagagatgaagaaaatcaagatgtacttttattcattgataacatctttagatttactcaagccggtagtgaagtttctgctttacttggtagaatgccttcagccgtaggttatcaaccaacacttgctacagaaatgggtgcattacaagaaagaatcacatctacaaagaatggttcaattacatcggttcaagcggtatacgtacctgccgatgacttaacagaccctgctcctgcaacaacattcgctcacttggatgctacaactgtactttcaagagcaatcagtgaaaaaggtatttatcctgctgttgaccctcttgaatcaacaagtagaattttggatccaaaagtagttggtgaagaacattatcaaattgcaagaggagttcaagaaatacttcaaagatacaaagaacttcaagatatcattgcaattttaggtatggaagaattaagcgaagaagataaacttattgttggaagagcaagaaaaattgaaagattcttatctcaaccattccatgttgctgaacaatttacaggtttacaaggagcatatgttcctatttcagaaactcttagaggctttaaagaaatcttacaaggtaaacatgatgatttacctgaagctgcatttttacttgttggaacaattgatgatgcagttaaaaaagcaaaagaaattgaagaaactgaataataaaaaaaatacatttatgattttcataaatgtatttttttattgcaataaataaaaaagccttaagaatatcttaaggcttaaatttcaaaaatggtgatccgtcaggggatcgaaccctggacaccctgattaagagtcaggtgctctgccagctgagctaacggaccatttatcatgctttattattataataaagtatgataaaaaagtcaataatttacaaatataaaatatttaaaagaggaagagctaaatattttttttcctataatattgtaacctaagattaaataaagttttaaaattgttaaattagatttttcagtttttttatgaccgtgaaatgttttgcttcaaatgaagtttttttaccaagtttaaggatgtttttcttatgcatgaatgtagtatatttaatatatatcagatttttcattgtttgttaaatttatttttattttgtatatgcaaaagtcctatgttttataacatagaacttttgttttataatgtttttctgtattctttaacgatatccataaactcttttactctttgtccgtctacttaattttcgaatttaccgtcaactttgaatgttgttgcaacaacagcaccatctgcatgttttagttgttcaattatattatttttgttacatcctgtattacataaaactgttgtatcaggtactgcatttttaactttcattaatgtttgcgtatctgttggagagcctgccgtaagtccagaaacgcaaagtgcatcaggtttatggttaaatacggtagattttgctattgactcaataggtctttcagctaaatatacagctgcttccggaacaatattataaagaagtttaacgttttctgcgccgattttatattggtgtcttacagttttcccctgcatttgtgttccaaagcccaaagtcagaagcataaacaccgcttatgatttctcttataaacttagcgccgacagatactgctaaatcaagagatgcaatgggatcccataaacagttcacaccataaggtatttttatatcaggcattaatcttcctattatgtaagccatagccgctacagtgggagtttctacttttgttaaatatggtaaactgaattcatttgagaacattacaccgtctactcctccatcttgtagtgctaaaaattctcttctggctttttcgattactttttccattcctccttctttatcaaatccgggatctgatggaagtgcaggtaaatggcacattgcaataataggtttttctacattaaagatttcttttgtccaactcattttatttcctccttagtatttaattggattaaagttttatttgcatatattttaagaagagtattcttctaatgcgtttatataattttcacttgaaaaaacatatcttcctacaacggctgtatctatatcaagatcttttattttttctattgtttcttttgatagtcctccgtctacccatatctttacgtgagaaggtaggacttcctttgcttcttttattttttcgattacaggttcataaaaagtcactcctttattatcaggctctgcagtcattaaaattatataatttatatcatttaaaaaaggttttaaataacttataggtgtagatatgtttaatgcaaaacctatattttcaaatttgcatttttttgcaagattgataaattccaaagggtataataaaggttctatatggcagcttatagattttatatttaattttgacaaattttcaacaaattgaagaggttcttttacaacaaggtgtgtatcaatctctttttcaggtgcatattttgatattaattttgccgtttttattccaaatgttatgtttgggctaaaactactgtcttcaatgtcaagatgaagtaaaggccattcttttaatttatcaagttcttcttttatatttaatgtgttagaagaggctattgaaggatttaatttcattttctttctcctttcctatttcttgagtagaatataacacaatatgagaataaatgcaatagtttgatacaaaaaatattaaaatttatcattttgtatcataaatattactttaagtaattatatatgtaaattgataagcttttaaataaagggttttatgggttgaaaagaaaatcatttaatgatataatttgagaaaataatataaaataataaagtaggtaagattatgatacaaattgaaagatttgataggatattggaaatagtggatcagagaggttatgttagcgtaaatgagcttgaaaaaattctcgatgtttccagagcaactatttacagagatttgaaagacttgaatattcaagggaaattaaatgtaacaagaggaggggtaagtaaaattaatcaaggcagtagttttgaaatgccatattatgaaaagaaatcacataatacagaagaaaaaataagaattgccaaaacagctttgggttttattaatacaaatcaaactatttttatggattcaagcacgactgtaactgaaatgacatcttttatgaatgattataaagatattcaggttattacaaatgatttaaaaattgcttccaatttatcaggtgctaaaaatatgcaagttataattgcaggcggcgttttacgacatggtttttatactgtttccggttttttaacagagcaaaacttaaattctcttagggtagatatatcatttatgagttttgatgcaataagtttggatgggggatgcatgataacaaatatggaagaagtttccataaaaaatctgggaataaaaaaagcaagacagaaaattttgttatgtgatcattcaaaatttgaaaaaaatgcttttgcttctgtttgtggattaaaagacattgatataataataacaggaaaagagcttgatgaaaatatatataaagaatatattgagaatgaaattaatattataagggtttaaaaaagtgccttatggcacttttttaatatatctcatcagtgattatttttgcacattcttcaagttttcctctgtctaatgcaaatttgaatacactgtaacgttctcttattttatgacagtttaacatgctttcataaaatagatttttatctattccgatatcttttggtaaaaccggatttcccattatttttaacatattttctatatcttctggagtataaacattttccattatattgttaggtataatatctcttaataggtaaaacatttttgaaacaattggagtggcaattcctacttttattccatgtagctcagggtatctattattttttataaaatctacttcccaataatgtgaaagcatatgttctgctcctgatgcaggacgagaaacaccaacaagtcccattgcaactcctgtaagtgtaagggcttcaattaagtattttattgcattttcatctctgtcttttaatttatcagcgctgttaattgttttttgaacagcttcttttgttaattgaatacaggtttcgcagtagtattcatcgtttatttcttttgataattcccagtccattaaagcagttattttacctattatatctccatatccggctcttataagtttcattggagcatttttcattatgtttatatctcctatgattgcataagctaaagttgcattaaaagatattttcattccgttacatataagaggagcgccgtctgatgcataaccgtccattgaaggagccgtgcatatgattatatatggaatacctgtttttatggataagaatttaccaatatcgtttatggttccacttcctatggctataataagttttgtatcgttgtccatttccataaaaagtctgccaacaactttttcatcagggattaatatttcttctccggtttcaattataaaatttttataattataattgtttttatctagttcatttaacgtttcttttcctgcggcgttaaatgtatttgtatcactaaaaacaaatatcttattatctttaaaaggtgatattattctgtcaagttcttctattgcattttcttttatacatatatcgtgtatgttcaaagtatgttttttcccgcattcacaatcaaaactcaggtttgacatttcatttatactcatttctaatatatatttcattttaatctcctttttattttctatggtatacttccatttcgtatcttgttttgtatgcgtttgattttgcttcgacatattcaattggttcatttgttattgtataagttgttgattttaataaacttattggatcatttaatttaatgtctaaatgcattgcatcgtattcatcagctttaattattactaattcttgttttcctttataaggtattatgcctatatttgataatgttttgtacaaagatgcatttgtaaaatcttctttcattaaatattttgcatatttttttaataagtaagatgttgtaagggaaaacaatttatcatctatatatctttgtctttccagtttaaaaacttcatcaccttcatttatatttaatttttttgcaatatattcatcagctttccatatgttttgaaataaaactttactttttatttccttgccttgaagttttgcatcactgtaaaaacctaatgttgaagtaagttgatggtctatataagggctattgcctaaatagaaagtaccttttcgctctcgtttttctattaatccttcttcttcaataagttttaatgcagattttattgtaggcctgctgacgttatatttttcacaaagttctctttcgcttggtaatattgaataatatcctaagtttttaaagtctgttattaattcttcttttatttttttatataaaggttctttgctcattttacctcctttatatacccagtggatatattataattatatattatatcaagaaataaaaaaagtcaataaaaaaagtatatccagtggatatacttttaattattttatattattggttttttcatatatatatctatatctgtcacatagtttactttctaaaaatttgttttcaaattcttcaacatttttacaattttcggccattttttctattttttcaaataaaaaatcagtaaatttttttattttgctattatagcaatgattaaatattaaattttttcttgcatcaatggtcgcttttatatatgtatccattttatcactcctttaatatttatatacatatgttatcatttctttttgtcatttatttgtatattatctgataattaaaaattaatattgtgagattttattattattataaaattatatgcctttttttattaaagatttgtctttttttgatataataaacctataaaattttaaggagataacgttgaataattttgttgattattttgaagaaaatgaaataagtgaattaagcagcattaattttgaaaatcccgaaattggttttgatgtggattttaaaataaatgaccatatagaaattatcgatgtaaatgataaaatgttaaccatagaatttacaagaagtcttattgaattggatcttgatgaattgttccttgaaataagcgttttgattacattcaaggttaagaaagaatttgataatacaattgtttttctatctaaaataaaacaagaggatttgaaaaaagtgatactcgaaaatgaggatttctttttaagctgttcaatttgtacagtttctcttttaatttctcaaattttgtctgcatttggtcgaattccaccaattacgccgcctttatttataaaagaataaattttaatattgtctaaattttcaaaaaactattgacaattcttttaaaaggtagtatcatcaaaacaacattaatatagaaaaccgtagagaaagagtagtagacaagataagaatgatttacagagagttataagacggtgagattatagcatgatttccttgttgaatggacttttgagggtggctttgaaatgaaaaaagtatgggccatcgggcacccgacccgttatcataaagggcgtatatgatggtatacgaatttgagtgggcatattatatatgtcaatttgagtggcaacgcggatatttcgcctcaagcaattttgcttgaggctttttctatattaaaaataaaaatttttaataaagagaggaaagacaaatgaaaatgaaaaaagtattaatggtaggactaagtttaatgtgtatggcaggagtgcttgcaggatgtggtaattcatcaggatcaagtgatggaaattatgaaataggtattttacaatttgcaaatcacggttctttggataactgcagagaaggttttttacaaggattaaaggaagaaggaattgaagaaggaaagaatttaacagttacatataaaaattctggttcagatatggcaactgataatcaaattgcatcaagttttgcttcaaaagattatgatcttatttgtgcaatagcaactccaagtgcacaaagcgcatacaacgcaactaaagataaggatactcccgttgtttacacagctgttacatctccaaaacttgctggatttgtagacgataataataaaaatgttggaaatataacaggtacatctgatttgattttggcagacgaacaattaaaattaataaaagatatgatgcctgatgttaaaaatgtaggaattctttacagtacaagtgaagttaattcacagtcaggtattgaagcatatgaaaatgcagcttcaaaatatggaataactattgttacacaaggtataagctcttctgctgatattcctatggcaacagacagtttacttaaaaaagttgattgtataacaaatttaactgataatactgttgtaagcaatcttccaacaattttagataaagcaaacaaagcgaaaattccagttttcggttctgaagttgaacaaataaaaaatggttgtattgcttgtgtcggtattgattatgtaaaacttggaaaccaaacaggaaaaatggctgcaaaaatattaaaaggtgaagctacggcaaaagatatggaatttgaaacatttaatgctggcgaaattgttataaatacaaaagttgcatctgatcttggaataacaattcctgatagtgtacaatcaagtgcttcacaaacttttgatagtgttgcttctgaagaataataataatttaattgccatatataagttttcttatatatggcaaactataaaagtttataaatataagattaatatttaatttcatatttatacattttaagaaaagaggagagtgttttggatttattacttagtatttttgaacagggctttatatatgcaataatggctcttggcgtatatattacatataaaattttggattttccggatttatcagttgacggaacttttccccttggggctgcaattactgcagtacttattacaatgggagttaatccttatgtaactttaataatttctctacttgggggagctttagccggagtgcttacgggtataatacacgtaaagtttaaagtaagggacttgctttcagggattattatgatgacggctttatatactataaatttacgaatagccggtggagtggcaaatgttcctatttttaattataaaactatttttgataatgattttataaatggtattttccctgattccatatcgcagtttaaaacagttatagtagtttttattatacttttaattgctaaattattacttgatttatatttaaaaacaaaatcaggatatttattaagagcagtaggggataatgaaaaaatagttacttctcttgcaaaagacagcggaataacaaagataattgggcttgctcttgcaaatgggcttgttgctcttgcgggaagtgtaatgtgtcaacaacaaagattttttgaaattacaatgggaacgggaacaatcgttataggtcttgcaagcgtaataataggtatgaatgtttttaaaacaaataagttaaaagcaactaccgcagttgttttaggttctgttatttataaggcatgtgttgcaatagctattgaatgtggacttgaagcttctgatttgaaacttgtaacggctgttttattctttgttattttggtattcagcatggataggaagaagaaggtgaaatcatgataaaacttgaacatatagataaatattttaatataggaactataaacgaattatgtttatttaaagattttaacttagatattaatgacggtgattttatttctgttataggaagtaacggttcaggaaaaactacggtattaaacttaatatgtggaagtttagaacctgaaaatggtaaaattatattagataatgaagatataacaaaacaaaaagaatatataagaagtagaaaaataggaagagtatatcaagatccgtcaatgggaacttgtccaagcatgactatacttgaaaatatgtccttagctgataataaaggaaaatcttatgggcttggaatggggacaaataagaagagagtaaattattataaagatcttttgtctagattaaaccttggacttgaaaatatgctagatacgaaagttggtgcattatcaggagggcaaagacaggcaatggctcttttaatgacaacaatgtcagatataaaattcttaattttagatgagcatacagctgcgcttgatcctaaaactgctgaacttataatgaaatttacagatgagattgtaaaagaaaagaagataactacaataatggtaactcataatcttcgttttgctactgaatatggaaatagaattttaatgatgcataaaggtaatgtgattattgataaagcaggggaagaaaaagaaaatatagatatagatgatcttctttctaaatttaatgaaataagcattgaacttggaaattcaatataaaaaaagaccttatataaggtctttttttatatttcatctttttttgttaaacacatttttacagaatgtttccagcctgcatataattcttttcttttctcttctgttatttcactattaaaaagtttgcttgtttttcttacttcttttaattctttttcactattccatactcctgttgcaagtccagcaaggaatgctgctcccattgctgtagattctatgcagtttggtttgtttacagggcagtttagtatatctgattggaactgcattataaagtcgttttgacaagcacctccgtcaaccataagttcttttagaggaatcttactgtcatcttctattgcatcaaggagatcttttgtttgataacagatgctttcaagagctgctcttacaatatgcgctttttttgctcctcttgtaattccggttataattccttttgcatacatatcccaataaggagctccaagacctgtaaatgcaggcactatatatacaccattagtatcatttacacttgttgcgatttgatatgtttctgctgctgtttgaatcataccaagttcatctcttagccactgaacaacagctcctccaataaatacgcttccttcaagggcataagtgatttttccgtcaataccataagcgatagttgttaaaagtccgttatgagattttattggttcttctcctgtattcataagtaggaatagtcctgtaccgtatgtattttttgcttctcctatattgtagcatccttgaccgaatagggcagattgttgatctcctgcaacgcctgcaataggaatttcttttcctaaaatttctttatccatatatccaattatcccactgctattaacaacttcaggtaagatatttttaggaatatctaaagcttccattattttttcatcccattttagattatggatatcataaagcattgttcttgatgcatttgtgtagtctgttgcatgtacttttccttttgttagattgtatataagccatgtatcaatggttccaaaaagaattttcccttcttcggctttctttcttgctccctcgacattatctaaaatccatttaatttttgttgcagagaaataagcatcaatcttaagtcctgttgtatttattatatgttgttcaagacctttttctcttaggtcttcgcatatatctgcagttcttctgcactgccatactattgcgttatatattgggtatcctgtatctttatcccataaaacagtggtttctctttgattagttataccgactcctttaatatcatcaatatttatattagctttttgaacacattgttttatggtaaacaattgtgtcatccatatttccattgcgtcatgctcaacatatcctgcctttggataaatttgtttgaattctctttgttcaacactgactatgtctgcgttttcatcaaataaaatcgttctacagcttgttgtaccttggtcgattgccaatatatattttttcataggctcacctctttatgtttatatatactattatacttcattatgtatacgtttagcaatataataattttatgtaaatagtttgtaaatataatattaagatatttattttaatgatataatataaaataatatgattaaaggtaatataaaatggatatatataaattttttgataagaacaaaaattatacaaaattagaagaaagaattattgattatttttatgataatatagattctattttttttatgacaattggtgaaatttcaaaagatttaaacatttctcaagcaacgatttctagatttgttaggcatgctggatattcaaattttaaatctttaaagaatgcaattttaagtaatctgggaaaaaagacacccggggaaaaaattagagtatctatagacaaaaatattgatgatccgatatcttctttttatttatatcaacagaattgcattaataaaacttttgatatgcttgatttaaatgtaattgataatatttcacaaagtattattgattctaaaaatatctttttatatggtaaaggtgctgcaaaaagtttatgtgatttattaaaatttagattaaaacgatttgggaaaaatgtaattataatgaattcaagcggctcggaaatgtttgaagatttaattaatattagaaaagatgatttagttataattttttcctttgaaaatttatcaaaagaagttgaagttattttatcttatgcaaagaaggtttactttaaaactgcaatttttaccagaagaaaacatgataagttattagattgcgttgactttgttgtaaatgtgtatagaggacaacctaatgaatatcattcaatggctgctcctgttattcttttagatagcttggtaattttaacggcatataaaatgggagaagatgttataaataaattggaagaacttcattgcttaaaagattattatatagataaaataccaagataagtatttcatacttatcttggcgatactaaaacatcaacataatttccacccatagaatagattttctttaaacatttttttaataatgttgcactctcaacttgtatatctatactttcagaaatattaattgaatatttattattttttattgaatattttaattgttcaatagtattaatatcatcaaatatactgttataaatacaaccatattgagttgcttgatgagtatcacttcctgctatataattgatatttagtttttcacttaattcttttgttttatttattgtgtagtctttatttaaagcaatatcttttccatttaagtctataaaatcaagttgatttaataatttaaggggtagagatggtatattgcttccttttctgtaagggtgagctgctcctataattatattataagatttaagaagagatattaaattttcaagaataaaacaatacacaaaaaaagcataacaaattaaagcttatactaaaagcattgtcaagctcagataataatgtatttctaaatacgaatacaatcattgtaatgattagcataatattaaaaaataaattactttttttacttatactatccacagattttctccttattactaaatacatattatacacctaaatataatattttgacaaatttttaatcgtttattaataaaaagtatcttaaaatgataaaaatcactttaagatacttatattaatcattttttgcttcattatatgtaggacaaagtttttttatttcttccctaatattatccggatttttatatgcagtatcaataagattatctaaatcaacaaaaaacttgtctatatctatatcaataggttttgcaatataaatcatatgattttttgttcctgtaagaccttcttcttccataagaatttcttcatacattttttctccgggtcttaacccaacaacttctatttttatgtcttcatttggaacataaccttttaatttaatcaagttaaccgccaagtcataaattttaacaggttttcccatatcaagaacaaagatttcgccgccttttgcaagaagtcctgcttgaattacaagagaaacagcttctcttacagtcatgaaaaatcttgtaacttctttatgagttacggtaacaggtcccccttcttctatttgttttaagaataaaggaataacagagccattacttccaagtacattaccaaatcttacagcaacaaattctgtcttagaaattttattatagctttgtataattttttcacatattctcttggtagcccccataacgtttgtaggtcttacagctttatctgtagaaattaatacaaatcttttaacttcatatttatccgcaagattaacaagatttaaagttcccttacagttattttttacagcttcgttaggagaatattccattaaaggaacgtgcttatgtgcagctgcatgataaacaatttgaggattatattttttaaatatacactccattctatcataatctctaatggaagcaataagcacacgtacatcaatctcaggatgttttcttttaagttccatttgaagttcatatgccgtattttcatatatgtcaacaacaagcaacttatcaggtttatttgcagcaatttgtctgcaaagttcagaaccgatagttcctccaccccctgtaaccataacggtttttccgtcaataaaagtcctaagttctttattttttatatctacagcagctcttccaagtaagtcttcataattaacttctctgaccttttgagttaaagatgtagtaaggctttttgaaattgctggtaatattttaagttttacactagtttgattacatatagtaataatatctcttattgtgtcaacagatgcagaaggcattgctataattatttcatctatgtcatatttgttaatattaaataaaatatcatctcttccgccaacaatagggatattatgtatatatttcccttttttttcctcattatcgtctattatacatactacttcatagtgtttcataccgtttctgatttctttaataagcaaagaaccagcagaaccggcacctataatcataacatttctttttaattcgcttttattttttcttataatgattcctttataaattcttacagataaacgagaaagtgcaattaatacaaaaagaaaagtaaaatcaaagaaatagtaacttcttggcatcccaacatctaagtaaacatgataaataatgtaaataatttcaattacaacagcagatttaaaagcagaaacgacttcatccatagatgcataagtccatactctgttatacattttgaaaatagcaagaacagctattgcaattacaatatcaagtggtaaaaatcttagtgcaggatataaaaatcttgaaggtattataaataaatcaaaccttaataaaagtgacattatcatactgaatgacactattaaaatatctattaataataatattattaatctttttttcttcgtcaatttttttctccccaaataataaaaaaatgattgattttacataattaaactttgacataaagtatactacgaacccaataaattgtcaaacttcgagctttttctacaaataaatataatatgaaaaaactatcttattttcattttaaatatattatgttataattaattgttattaattatttaagaaggtaaaagaaatgaaaaattatggttttataaaagttgcaacaggagttccaaaggtaaaagttgcaaatcccgaatacaacaaagaacaaataattgaattaataaataaagcaaatgaaaaaaatgtaaagatacttataacacccgagttatctataagtgcatatacatgtgcagacttattttttcaagatacgctgttagatcaatgcgaaaaagctttattagatatattaaaatacacaaagcaaattgacattgcaattgttgttggcatgcctattagatataaaaatgctttatataactgtgctgttatgatgcttagaggtgaaattttaggcgtaatacctaaacaatatattccaattcataatgaattttatgaaaaaagatggtttgcaagtggaagagatgtttatgatgaaataaaaattgcaaatcagacagttccttttggtcaaatgctatttaaactaagaaaagacttaacagtaggaatagaagtatgtgaagacttatgggttcctatccctccaagcagtaatcttgcattaagcggagcaaatttaattttaaatatatctgcaagcaatgaagttgtttcaaaggatgaatacagaacaagcttaatagtatctcaaagtgcgaaatgcttatgcggatatgtatatgtttccgccggtgttcatgaatcaactacagatttactatttggcggcagcagtgtaattgcggaaaatggtattttattaaataaaggcaaaagatttgaaagagaaaatgaacttacttattcatatatagatatgggaaaactaaatttccaaagacgtcaaaatatgagttttaatgataataagagagaatatgatttagaatatgatgttattgaaagacattttattgataatgaaatatctgattttgatagatatattgatcctcatccattcattccaagcaatgaagaacttagaattgaaagatgtaatgaaatattcagtattcaatcttctgcccttgcaaaaagacttgaacatacagggcttaagaaattagtcgttggaatatcagggggacttgattctacattggctttacttgttgcaagtgaaacaatgaaacttttaaaacttccaagtgaaaatataattggtattacaatgcccggatttggaacaactgatagaacttatactaatgcacttgatttaatgaaatcccttaatgtaactataaaagaaataagcataaaagaagctgcaactcttcatatgaaagatattgaacatgatataaacatacatgacataacatatgaaaatacacaagcaagagaaagaacacaaattcttatggacatggcaaacaaaaatggtgcaatattagttggtactggagatttaagcgaaatggcacttggctggtgcacatataacggtgaccatatgagtatgtacggagtaaacgcaagcgttccaaagacattggtttctcatttggtaagaacagttgctatgataagcgataaaaaaacaaaagaaatattacttgatattttagatacaccaataagccctgaacttttaccaccaacaaaagacggaaagatagaacaaaaaacagaagataacattggtccttatgaacttcatgatttcttcttatataacttcataagatgcggtgcaaagaaaaacaaacttcatttccttgcaaaacaagcatttaaagaaaaatattcagatgaagtaatagaaaaatggttaaataactttatgagaagatttttcatttctcaatttaaacgttcatgtacaccggacgctcccaaagttggttcggtaagtttaagtccaagaggagattttagaatgccaagtgatgcagatttttcttcttggttggaagaataaaaaaagatgacatttagtcatctttttttaatatcttacaccgttaaaatcaatctttaaaggatataaatcatatttatcttttaattttcttaaatcaaatcttaattttttaagatcaatgtttccttcatagacacccataatggtaggccctgcaccggataaatatgttcccacaaaaccatattttttagttaaatttaccacatcatcatatccgtttattaagtcttttctatatggttcatgaattttatcttgaagtgcatctttaacaaattcactgtcccctctttctaaactaagaggaagtaaagatgctctttgtatgttaaatacaacatcttctctcgaatatttttccggaagaacatttcttgctttttttgttgaaagcttaaaacgaggaataaacgcacatatcctatattttttatttgcatttattttataatatttaaactcatcatcttgtttataagaaagcgtagtaccaccaaaaatacaaggagctacattatcgggatgtccttctatacttgaggcaatattgaacacatcatcaatatcaacctctacattaagaactttatatgccattattattcctgctacaacacaagttgcgctgcttcctagtcctctagttgaaggaacatcgctaaaaacatcaacttttacaggaaccggttctttatctaaaaatctacaagcagtaagcatacttgttaaaataagattgtttgtattgttaatgtcttctactcttccgtcaaatatgtatttatcacttttttctactttaaaagtattgtataaagttactgcaagtccaaatgtatcaaatccacaacatatattggcacttgtagccggagcttttatttcaaacattattttctaccttctatatattttattattgaatttctcatatcttcttttgtaataacttcttcttctcttctttcgaagttttcgatattatcaacggcttttgggatttttacatttgttttttcgtttaatttatacatatactcaacatcatcacttgcattaacttcatcatcaaaaattgagtgatatacgtctttagagaatttataagctgacgctgtagataataatacagaatatgtatcatcttcttttgtatctttatatactttatatcctgcagcagtatgagtatccattaagtaatcgtcgttttcataaacgtattttatagcttctcttatttcatcttcacttgcgtatcctccgatgaaattgtcagcattatccatatactctttatcaactgtatattttccgtcctcacttaatttagtcataagttcttttacttttttatcatctgagttatacatatgatatattaatctttcaaggtttgaagaaattaaaatatccattgaaggagaaattgtctttttaaattctctgtttttatcataaacacctgttttgaagaaatcgaaaagtacattattgtcatttgaagcacatatcaatttatttacaggaagacctgttaaataagcataatatccagctaaaatatttccaaagttacctgttggaactataaagtttactttatctccttctttaatttttccttgttctattaatcttacataagcatgataataataaacaacttgaggaagaagtcttcctatattaattgagtttgcagaagaaagttttactccgtatttttcaagttcctttgcaaattcactatcattaaaaatttcttttacaccattttgagtatcatcaaaattaccttttactgcataactttttacattcttacctttttgagtaagcatttgaagaagttgaagtcttgatacccctttatatggatagtaaactataacatcaataccatctatatcatgaaatccttctaaagcagctttacctgtgtccccgcttgtagctgttaaaataagaacatcatctttatcatttacattttcttttgcacaatttaataaaagaggtaaaatggaaagagcgcagtctttaaaagcaattgtatttcccgtaaataattcaagaacagaaagtccttcttcaacgtcaacaacgttaaaaatattttcattttcaaaattatctaaactgtaagccttatctacacaataatcaatttgttcctttgaaaaatctaaaaaagcacctaaaattgtttttgctatgtaattgtaagatttacctataaaatctttataatcaaattttacttcatctaaaaattcaggaacaaataaaccaccatcatcactaagaccttttattatagcttttgagggtgtaagcttattgtttttgtctcttgtactgttaaataatttttccataccaattctcctattttaaatctaattttaaatcacctggtttgatgatatttttctttctaaatatttcacttattacaagggttataaaagccggaagaacaaaatgcattaaaatcatcattgcaataacaccggttgaacttcccatagcttcaatcataccaaactgacctacaagtccgcttgttcccattcccgcaccatatgctgtatttgtcattttaaatacaacagtagacacaggccctagaattgcacttgtaattataggcggtaagaaaagcacaggctttttcatgatgttgcctatttggagcatacttgtcccaagtccttgtgaaataagaccttcaattttattttctctaaaactcattaccgcaaaaccaaccatttgacaagcacatcccacacacgctgcacctgcagcaagtccggataaattaagcattataccaagagctgcggaagatattggaagtgttaaaataatccccataattacacttaccaaaattcccattacaaaaggttcttgttcacaggctttcattattatatcacctaagaatgccataaaatcctgcattataggtcctacataatatccaactatacctgccgccaatactgtaacaatcggagttacgattatatctatgcttgtcctttttgaaataagcatacctaccacggaaccacttatcccacaaagaagagcacttatagggtctcctcctattaaccctgcaccaccacatgcaaatattacaagaggatcagccttaagtccgtatgaaacactgactgctataacaggtgctgtcattgtttttaaagccggatacaatgtatcagttaaaaaacttatattaaacacaacacctatttgatttaatatacttcctataattaaagtagaaaacagtccaagtgccatacttgataatgtgtcaataaaatattttttaaaaaaatctttcaaaggtcttttctcctaatcttctctttcaagtgcttttaattcttcatccaaatgttcttctatttcatcatgttttgaatggttaggacaatttttattgtcacattctttattgttacaatgttttttctttctctttaaaacttttacttcatcgtttttatattctttaaaagcaatatctccatcattttcaaatttaacaagtaaagtttcttttaatacgtttagtctttctattgtaccaacaccatcttcggttttaactttatcagaaactcttggtagtcttgaaagagcatcttcatagcaattatgctcatattgaagacaacaaagaagtcttccgcatattcccgaaatttttgaaggattaagagataaaccttgttcttttgccatttttattgaaacaggttggaattctccaagccatttattacaacaaagttcacaaccacaaggtccaagccctccaagtattttggattcgtctcttacacctatttgtctaagttcaattctaattctaaatatagcagctaaattttttacaagttctctaaaatcaattctgccgtctgctgtaaaataaaaaattaccttttgagcattaaatgtatattctgctcttattagcttcatatcaagaccttgtttagctatttcttttttacaaatttccaaagctttttcagctttaacaagattttcttcgtgaatttttgtatcttttgctgttgcttttcttattaccggttttataggttttgttacttcttcatcttcaacatatttaaccttaccggcaacagtcccatattcgagacctcttgctgtttcaacaataacattatcctgtaattttaaataaatattttcaggatcaaaataatatatcttacctgcgggtttaaatcttacccccactactttttgcattaaatatcctcctcaatatacataaataaacttaaaaatgccaatgaggcattaacattataattaatcattaagtttatgtttaacattttatcaatgattttttttaatttgtgttttgtaacaagtttatttacttctttaacataatttttataattatttttatcttcattaaaagtaatatccaagttgctttccttatatattaacacatctgataaaaatttcattataaaaactgcataattttcaactttatttctatcctttacaagttttttgctaatatttacattatttaagttatttcctttaaatatagaaagtaaattttcaagcaaatatgttttttcttcatcagaaagagtagcattttcattactgtcatttacctttatttctatacaccttgaaagaatagttggtaaaatcatttctttttttgaagaagataatattataattgtatcttttacaggctcttccaatgtttttaaaaatgcattagcggcttcaacagtcatagcatcagcacaatgaacaacaaaaatattatatttgtattcactgcttgaaagagaaactttatactgcatctgtcttatctgctttatttttatgcttgcaccgtctttataaatatgagtaatatctatattattatttgtatttatttttaagcactcatcgcattcatcacaataatacctactgtttttacaatacaatgtttttaaaaattctaatatagtattatctaaaatttcttcttttgcaccataaaacaaataggcgtgagccatagtatcattatttatatgatttaacaaaatatctttttcggtttttaataaattaccaaacataattaatatttttcaaatctggcaacatctaagataaatacagttgcccctccaacttcaacgcttgcagaataagtagtaagaggactttccataaatgaagcatcaacaggagtagaaacaacctgttctctttttttacatatttttttcattatttcaagagctctttcaaccttttcatcttctgttcctatcatcaatgtaacattttttagttttagaaatccgcccattgtacttagtttagttacttggtaaccttcatctgtaagcgcatccgataaaataaatgcatcttcattttgaacaatcgctattattaatttcattgtattacctcctaaattatttttaattcttttgtataaatcattattaatttcttcaatactttttaatttattatcctctacacattcaattctttcaaaaccgtaattttttataagaaaatttacattttcataagcagacattaaatattcaaaattactttcgtgaatatctttttcatgctcatttgtaaatttattatctctgtcttttataagtttttgagaaactttagggtcaatatccaagaaaaatattttatcaggagtaggaattttaaacatattatattcataatccaacagccaatttaaaaattcttctcttttctttatatcttttattttacaaccttgatgaagcatatttgaagttacatatctgtctgcaataattattccaccattattataaaattcttcataatcctttttatatgttgcatatctatcaacggcataaaatgtagaagcaacctttgggtctatatcttctgcattacttccaaaatcaccgttcaaatacattttcaccaaagctgaagaatcactttcataattgggataacttgcccttaaaacattgtatccttcttcttttagtcttttaactaaaagttcactttgtgtttgctttccacttccatcaagcccttctattacaaatagttttcccttagccattatttctccttaataacatttataaattcattttctattcctagaatcgtttgtttatcttttatttcttttatataatctattatttccttattaattatttcccctggagtaagtataggatatcctggaggataaggaactataaaatcatagcttacacttcctaaactatcatctatttctactcttttcttttcaaaagataaagtttttctcatagaatattttattataggttcactatgtttaaaaataatatcccgttttttgcttacattagttttatattttttattgatatcttttaatgcactaattaaactatcaatatcactttttttactaagcagtccaagatataccaaaacatatttttctgttgaacattctgtaaatatatcataattattctccagtatttctgataatgaataaccatcaaaaccagtattatcaacacctatacataattttgtataatcatgaatatcactattaaattcttccaaataaaaatttgtattttcttctatctctttttttgcaccagtataccattcttttatttgacttaatatactttctcctttttcttctgcaaaggataccgcttcttctacactttgcaaaaacaaaaatgaaggagatgttgaagttgtcatcttgaaaaataatttcaacctttgaatatcaattatatcactgtttatatgtaaaagtgaagtttgagttaatccagatagtgtcttatgcatagatgtaattacaatatcactctgtgcggtaagtgctgaagcaggatattccttactaaaagaaaagtgcgctccatgagcctcatctacaattattataatttctctatttatttcttttattcttctacataaactttttatatcaattgaatatccaaaataacttggatatgttataaatactgcttttatatctttatttttatttaatgcagatatatattcttcttcacttattccaatatcattattctttggataaatataaataggattagcatcacttaaatataaaccataatatgatgaaatatgactatttcttggaatcaatattttatcattttcttttaaggaatataaaatggaacttataatccctcctgtgcttccatttactaaaataaaagaatattttgtattaaaaatatcagatattttattttgtaaatttagaataacatcattgggggataataaattatcattaaatgaaagttctgttaaatcttttaaataaaaatcatttattcttcctttatgtcccggcatatgaagtcttacgggatttttatgtatatatgttcttattctttcattaagttcttttttcatacaagccttttcttttgatatattttaaattattatatcataaaataaaatgataaatttaattattaatattttatttcaataaaatatataaatattaataataaggtgatataatatcataaaatgtaaataatgaatataaaggaggtctattatggctaatcaaaatatcgtgacaataacaaatgaaaattttgaaactgaagttttaaatagtgataaacctgttatggttgatttttgggcaacttggtgcggtccatgcagagggcttgctccaacaatagatgaaattgctgaagaatattctaataaaattaaagtatgtaaacttgatgttgatacaaatcaagaacttgcaattcagtttagagtaatgagcattcctacagttattttctttaaaggcggagaacaagtagcaagagaagtaggagcttatccaaaagaaaaatatgttgaaataatcaattcattataaaaaaagcaccacaaggtgctttttttttataatattttatattttattattttatataaattttattacaaattaataattaatatattttttcaaaatactaaaaaaagaagaaggatatctccttcttttttttataaaactttgtttaaaaagtctttagttctttgattttgaggatttccgattacttctgaaggtggtccttgttcgataataataccttcatccataaatataaccctatccgctacttctctggcaaaacctatttcgtgagtaacaatcaccattgtcatcccttgagcagcaagttctttcataacacttaaaacttccccaaccatttctgggtcaagggcagaagtaggttcatcaaacatcattatgtcaggctccattgcaagcgctcttgctatagcaactctttgttgttgtccacctgaaagtttcttaggatatacgtctgctttttcagcaagtcctactctttcaagaagttccaaagcttttttttctgcttcttcaggtgtttttaattttaaatctaccggagcaagcataatattttttttaacagttaaatgagggaaaagattaaattgttggaataccattccaatattttctctcattttattaatatcgtttttcttatctgttatcaacttaccgtcaatttcgatttcacctttagttggaacttccaaaagatttaaacatcttaaaaaagtacttttacctgagccggaaggaccgattatgcaaacaacttcgccttcttttatttcaagatctattccttttaaaacttctaactttttaaaatatttatgtagatctgttacttttaatttactcattggttactctcctttcaatgtaattagaaatcatagaaagtatagtaatcgctaccaaatacattatacctactatagtccatgtagcaaatgaattcattgttcttccgatataaatattggcttgatatactacctcgcctaaactaataacagaaataatagatgtatcctttagagtaataataaactgatttacaagagaaggaatacatattttaatagcttgaggtaatattacctttatcatagctctgcttttaggtaagcccaaacttctagctgcttccatttgacctttatcaacagcttgaatacctcctctaaaaatttcagacatatatgcaccggcatttaaagaaagagttattaaaccggctgcataagcagtaagtctaaaatccataccaaaagattgtattaactgaggaatactaaagtatacaaagaaacattgtaccaaaagcggtgttcctcttataatccataaataaaatttagatatagctttaaaaggtttaaaacttgataaccccataatacaagagataagccctaagaaaaacgctattattaatgatattattgttatttgtattgtcattgcaaacccttcaaaaagtaatggggctgcttcagtaaaaacctctattaaattcattaaatcactccaactatttttttatttctatttatctgcaatatatttatctaatattttttgatattctccactatctttaatattttttaaacctgtattgaacatttcaattagttctgaatttttaccttttaatacagcaaaaccataagaagaacctttttccatgtctgttaccatttttaatccgttaccttgagagataccataacccattacaggataatcttcaaaacaagctacagtatttccagttttaacatcttcgtacatttttggagaatctttaaagtaagaaatttcgaaaccatatttatcttttatagattcagcaaaagtagcaccttctgtacctgttttacaagctactgtttcaccttttaaatcttcatagcttttgattgttgtgttatcagctttaacagccataactacaccagaatcataatatggttcagagaaatcatatttttcttttctttcatctgttatactcatacctgcaattactgcgtcagcttgatttgattctaaagctgcaacagctgcatcaaaacctaaagattgaagttcataattaaaaccttgatcttttgctattgcatcaagtaactcaacatcaataccagtgaaattattgttttcatctgtaaattcaaatggtgcaaatgttgtatctgtagcaattatataagttttttctccgtttgcagaatcatctttagatccacaagctgtaaatcctataagcattcctacaactaataaacatgctaataatttttttccttttttcattttcttcctcctttaatctaaaatgataaaatactagttctattataacttattacgttaaaaataccaaatacttttataaaataaagctaatttttttaatttttaaattaaataaattatatttactttatttaattaaacaaatttaataattaagtttattttttacgtaatttttaccaaactgtatacttttttgaatagtcgtttttaattcttcaattgaatcaaaagctctttcttctctttcaaattctaaaaattctactttgatttttttgccataaatatctctatcgaaatcaaatatgtttgtttctactcttggggtttctctaaatgtaggatttacacctacattacttattccataaaagacttcgttatctattgtaactctacttacataaacacctcttttgggcataacttttaattcatctggaaaaatatttgcagtcggtattcctatctgtcttccaagatgtttaccttcacaaactataccttccaccatataaggtctgcctaaaaatttattggctttttgtatattaccgtcttttatataatttcttattgcagtagaacaaactctttcattgtcaatcttaaattcatctacgactttaatttcaaatcctttttcctttgaaagctttttaagtaattcactatttccgcttccgttttttccaaagtgataattaaaaccaactttcattttttgcatattaacattatctaaaacaagatttacaaattctgtatcttttaaattcataaaatcatagtcaaaagatataataaataaataatcaattcccatattagccaaatactctattttttcatccatagtcataagtcttttaggagattgttgtttatttattaaatccattgggtgtttgtcaaatgtaacaacgcagttttttaaacttttgtcttcttcttctataattttctcatgtcccaagtgtattccatcaaaataaccaaaggccatagataatttttcttttttatcagcttcaccaaacgaatgaaatattttcattatttttgttccccgtataaaatcttaattggtcttattaatatattttcttcttcgactcttttgcctacaccgataaacttatcatccaaatataaccttaccaatgaattctcttttatttcactgacatttgttaaaatattttttttgatcaaagcattaccgtttaatatgattttactgctttttggattaatatctactctctctaaatcctttaaaaacaaatcatcatcttgcaaaacatcttttaatcgaccgctaactactttttcttcaagttcacttaatgtaacactgttttctatatttagcgctccgttctttgttcttataagaccgctcataacagctcttgttccaagttctttgcctatatcgcttattaagcttcttatgtaagtcccttttgaacaggaaacttttatggtagcatatcttggcaaatcgttatcaataacttcaatatcatttatataaacttctcttgaaggaatttcaacttcttttccttccaacgcatatttatataacggtttaccttttacttttatggcagaatatattggaggagtctgagtaatattgcctttaaatttattaattgcaaaaataaactcatccaatgaaaaatcaggaagagaaaattctcttgtagccgtccatatatcataactgtcactttcttttccaaattctatatttgcaatatattctttttcaaacgcagtaatataactggaaagttttgtgcttctacctacaagaactcccattactcctgttgccataggatccagtgtaccgctatgtccgatttttttttcaccaagaatctttcttaccttaaaacaaacatcatggcttgtcatattttgctctttgttaatgcaaattacaccgtttatcaaattaaacctctaaatcaatatctttaagtattgttaaaatttcgtttttatctccttcaaaagtaaatccggcagctttaacatgtcctccaccgccaaattcttttgctatttcagcagcattaacatttccaccaccgcttcttaaagaaactttaaaagagttttcatctgctctttttacaagtgcagcaagtttacatcctttaatatatctaatagcatcaattagtccatcagtatcagtattttcatttatactttcatcatcaagcaccataaccaaaatttgattattgttaaaagcataaatactttctaaagatttttttcttataatcaaactttttaaatctttaagtttaaccatttcattaatcttaccttgatcaacaccaagttttaaaagtttacttccaataatatgagttgtaggagtagtgtttgaataagagaaattacctgtatcagtcgatattgctacatatataagacttgcaatatctaaaggcaatgtcccaagtattttagagcttattgcaaaaacaagctctccggttgcagcggctttttcacttacaacatttatatctccatattttgcatttgttacatgatgatctattactattgttttattgcataagtttcttaaatcatttccgaataaataatcttcactacttgaatccattgaaagacaaacatcatagtttgcttttaaatcatctaattttgcaacttcctcttccaaaatcatatcttctaaatttacaggaataggtgtttgaacatataaatcaacatctttacctataagtttaagtgtctttttcattgcaagtgatgatcctagagcatcaccgtcaggatttttgtgagtaagtattaaaaatgtattgttattttcaagaatttctataaatctatctatcattttattcatcctcttcaagatttaaacctgctaaaacttcgtctatatgcatcgcataatccaaagaatcatcaagttcaaaaataagttcaggagtattttttgtttgtaaaacttttgatatagactttcttaaaaagcccttagctttatcaagcactccaataatttcttctttcttattattttctcccattatacttacatatacttttgcatattttaaatcgggagttgcttttactcttgttacacttattattgcttcttttaatcttgggtcttgaagttcaagctcgattaaaagcgataattcgtttttaatcagctcgtttactctttctattctatatcccataaggttttttactctctttcgatttcttccattttgaatgtttcaaaaacatctccaactttaatatcattaaagttttcaacaccaataccacattcatatcctgattgtacttctcttacatcatctttaaatctcttaagagaagctatttcactttcaaatataactacaccgtctcttattattcttatcttgtcatttctgttaataacaccttcagtaacataagaaccggctaccaaaccaatatttggaaccttaaaggtttctcttacttcagccataccaacaataacttccttaaattcaggatcaagtaagcctttaagcgctttttcgatttcttccattacatgataaattacattgtaacttcttatttctacttcttcttttgcagctgctgtctttgcatttgcttcaggtcttacgttaaatgcgataataagagcatttgaagcagcggctaatgtaacgtcactttctgtaatagcacctacaccaccgtgaattacgcttactttaacaccatcttcattatcatttaatttttcaagagattgtgttaatgcttctaatgaaccttttacatcggccttaacaataagttttaattccttaagttcgccttcgcttatttgattgaataaatcatctaagcttacaggtccgctcttcttaagcgcattttctctcattatagcttttcttctttcggcaaattttcttccttctctttcattttcagcaacaaagaatttttcaccggcattaggaacttcattaaatcctaaaatttcaatagctgtagatggtcctgcaacttttattttattacctttatcatccatcatagctcttactttaccgtatacatcgttacatacaactgtatcaccgtcatttaagatacctgacttaacaagaagtgttgcaacagtacctttttgtttatcaagtctagcttcaataacagtacctacggcaggtttgcttggatgagcttttagttcttccacttctgctacaagaagtatcatttcaagtaaatcttcgataccttgtcttttctttgcagaaattttaacgcaaattgtatccccaccccaatcttcacttacaagtccatactcagtaagttcttgcattactctatcagggtttgcaccaggtttatctattttatttattgcaacaataataggtacccctgcatctttggcatggtttatagcttcaactgtttgaggcataaccccgtcatcagcagctactacaagtactgctatatctgtaacagatgcacctcttgaacgcatagctgtaaaagcttcatgtccaggagtatcaataaatgtgattttttcattattgattgtaattgtataagcaccaatatgttgtgtaataccaccggcttcacctgcaattacgtttgtatgtcttattgcgtcaagtaaagatgttttaccatggtcaacatgtcccattactgtaataataggtggtctttttacaagttcatcttcattttcatagtgagaatcaaataaatcatcaattgctttattttcatcttcaagattacatgttatttcaaactcttcacaaacaatagaagcagtatcaaaatcaattgattgattcaagtttgccattactccatagcccattaagatttttataacttctgttggagctttgtttattttagcagcaagttcacttacagtaattccatccggaattgtgatttcgctaaccaaagaattttctaattgtttttcttctctttcttgtttgtttttctttttatattttgatttagaaaccttagatttctttgaattatcaataaatttaggaactacttcttttttatcttttttatttttcttatttttctttgaaccgtagcttttttcattcttttgatttctattatcattttttttgtttttaaatttttcaccttttacaacattatcatttttatcatcattactgtcataatcataatgtttgttacttttcttaggcttgtttttattattcttcttttcttcattatatattacaacaacttcaggttctttttctcccttattgtcagatttaacaaaacgagtatttttattgtttttcttattatccttttgttttttatcaataggattttttctttcttcttttttatttgtcttttcatcttcgttttgttcttgtgttttatcaacaggtttatttcctttattttttaaataatcctctttattaaaattatttctaaaatatttttcttgttgtgcgcttacggcactcatatgattttttacgggaatacccatatttttcattatttcagcaaactctttacttggaaagccatattctttagccatatcgtaaactctcatactaaaaaaccctccttactttattttatatactttaaaacctcttcttttagaggaataatatcatcattagtaagattcatattaagagaattgtttattatttttgcatttaccattttttctatgcaatcgggatttttacaaatatatgctcctcgcccgttcattttaccgcttttatcaaaaacaactttgttgttttctttatcccttacaattcttaataaatctcttttgttaaatttttctctgcaaatcaagcatgttctaagtggtgtctttttcattttccacctcttaaattattcttcatcttctgaaagtaaaacttcttcaacgctgtctaaaatatttatttcactatcggcattttcactttcaaatttgcttttgcttttaatatcaatcttccaacctgtaagtcttgcagcaagtcttacgttttgtccgtctttacctattgcaagagaaagttgagaatcatctacaacaaccatagcagaatttttcccgtcgttttcttctgtttgtaaaatatcaacttttaaaacttcggcaggagctaatgcatttttaatgtattcaacaggatcttcactccatttaataatatcaattttttcttcaccaatttcatttaatacattttgaattctgattcctttaggtccaatacatgttccaacaggatcaatttgttcatcttcagaataaacagcaagtttgcttctacttccggcttctcttgaaattgatttaatttcaaccactccgtctgaaatttcagcaacttcttcttcaaataatcttttaacaagtcccggatgtgttcttgaaagaattatttgaggtcctcttgttgttattattacatctgcaacataaactttaagtctcattccaggatgataatgttcactttttacttggttttggctgttcattataccttcagccttacctaaatcaatatggataattctgttttgttcaattacaggttctccatgaatcattttctttacttctttatattcttctctttgaataacaccgcttaccatttcatcttttttcttcatgaatgtattgctgatgatatttctttctgattctttaagtttttgaataataagttgttttgcgttttgtgttgcaattctaccaaaaccttttggatcaatatgagttataacacttcccccaagaacagcgcttttatcaagaaccaatgcttcatgaagtgaaatttccttatcgtcatcttcaacttcttctacaatttcttttgagtaaaaagcatcaatagcccctgttgttctgtttatgtttacaaccaaatcaacattgcttcttgtgtcttttttgtaagcagcaacaagagcttgctcaactgctactataatttcttctttatctataccttttgatttgttaatctcatctaatgcttcaataaaatcttttaaagaatgatctgcttcttgttttttctttcttgccatttttttactccttatttaaaatttaaaatcaaaactcaaattaactttgcttatatcttcttttggaatagccatatgatcatcgtctaccaaaactaaaacttttccgtcttcatacccttccaaaataccactgaatttttttcttccgtccactgacttaaaaagtgcaacatctatctttttacccgtaaactttataaaatctttttctttttttataactctgtttactccgggagaagatacttccaaaatatattcttcttctattatgtcttcttcatcaagcatatctgatataagtcttgttacattacttatatcatcaaggttgactctcccttcaattctttcaatatataatcttaaaactttgttgtttccttcttttttaaattctatatcaacaagttcaagcccattttcacttaagatatcttcacttaaagcttcaattttatctgtaattttcaatataaagcctcctaaataaaacaatataaaacaatgagtggacatacgcccactcatctagcctgaattattatacaccctaaaatcaaaaaaagcaataaaaaagcctcatttttatgattaaaccagtgttttaaggtaaaaaaacatgtaaaaacataaaaaaagaagcataaaaatgcttctttaaaattaatcttcaattatttttacataaaatcttctgtgtcttggaccatcaaattcagcaaagtatataccctgccatgtaccaagcaacaattcattatccttaacgattatggtttcactacatccaacaacacttgtttttatatgcgctgtactgtttccttcatagtgtctaaattctctcatatcagggaaaaacttatcaaaggcaaataacatatcaccaacaacgtcaggatctgcagcttcatttattgttattcctgcggttgtatgaggagaaaatactgtacataaaccattttgcactttgctttccttaagtgcacttttaaccatatccgttatattatggaaattttcattatcagttctaagatcaaattcaaaaagcataataaactcctttataatatctttttcttatatatattataacattaattattaaaaaagttatcggaatcattataatgttcgttaaaattaaaatcatggttattattaaaaagattataatgacttgttgttgtaaagtaaattgttccagcaaacatcaatacaatcataacagctaaaacggcagctctgattttcttactctgatataaaagaaacaatccaataacaaccaagaataaaggccacattaaatctattgcttttacaaatccagaaaaagagagaatataaatatcaagcaaatttaagatgcatccggcaccaataactattaaaagagttccaagtattatttttagatttctattcatgattttcattaacctcttctctcattttctttatttcttcaattgtaaattcacctttatcagagtcattttcggtttctttgatttcttcttttatatttaaatctttaccttgctcttcttttataatgttttctttttcgcccctatcatcttccttaatattattttcttctttttcaacgttattcttttcattatttgcattattaacatcatcataatttatattgttcacattttcataattaacatttttatttttttctttaaatggaacacttgatactattaaaagaagccctgcaatcaacaaacaaacaggaacgataaaatctgacatatattttggaagtacattcccaagaaataaaataacacctattacaactaaaaacaaacctatcttttgttgatttttatttttgttaattttatcaccctcaaaattataagcccctgaattgaaattcgtattatactcatttacacctgaactattagagtaaaaagaagaaaactttttactatgcattgtatattctcttataggctcataaggaattaaaaaacaaagtaaaagatatataaaaattagaataccacttgtaacaagtccaagaattattgctactattcttattattatagaatctacatcaaaatactctcctattcccccacatactcccccaaaccatttatcatctctgcttttatatagttttttttcattcatatcaaagatgtcctccaaagcaaatttatatgtttatataatatataaatattattaaatttgcaattaatctaacattaaaaacccattaaaatattttatgttataaagcatattgtttttgcttttaatataaccccatgatataatttagttaactttaagccttaagaatggagattttatgaataagcaagaacaaattttaaatgactttttggttgaaatatttaatgagatactaaaagttgaaggtaatgctttaaaaaaaggtaaattcaaaaacctttcaataagagaaatgcacgtaatagaagccgtggtaaaaaacgaaaaagccggaaataatacatcttcaaacattgcaaaatcattaaatattactcccggaacattaacaataagcgttaatgctcttgaaaaaaaaggttatttaaaaagagaaagaaacgatgaagacaaaagagtcataaaaatttatgcaacaaaacttggacacgaagtagaaaaaaatcatgcacaatttcacgaaaatatggtaagagaaatgcttaattttttcccagaagaaaaaagagaagttcttattcaaggcgtagttgaacttgaaaaattctttacaaataaaagcaaggcaggtgaataaaatggtaagaataattgtagacagtacatgcgatttaagcaaagaaattgtagaaaaacttgatattacggtagtacctttaacggtaagatttggcgatgatgaatttttggacagtgtaaatatcaccaatgatgatttttatcaaaaattacttttagcacacgacaatcttccaaccacatcacaaccaagcccaataaagtttaaagaagtatttgaaaaatatatagcacaaggtgatgaaatagttgcaataatggtatcttcaaaattaagcggtaccatgcagtccgcaacaatagcaaaaaatgaagtagatgaagacaaaatttatattgtagattcaaaaattgcaagctttggaacatatcttcttataaatgaagccgtaaagatgagagacgaagggaaaagcgccagtgaaattgcaataaaaatagagcatttgacaaaaaatttgagactattcgtttgcttgaataccttaaaatatttaatgtatggaggaagaatatccaaaacaacagcagcaataggcgagatgttaaatattaatccagtattaaaggcagttgacggagaacttgtacaggaaggaaaagtaagaggcaaaaaattatcttacaaattcatgcttgaaagagtaaagggtaacattgattattcttatcctgtaacatttggacattctcatgcacataaagccattgaaaactttaaagatttcatgtataaacaccttccaatagaagaaagcgaaataatttcaataggtccgacagttggaacatatgccggtcccggagcaataggcattgcctatgtccaaaaagaaaataatgaagaaaacaaatagacataaaaacacatctttaaagatgtgtttttagtttaatttaaaatgaaagtttgaatcagttttttaaacatattcaaaaataaaattatataaatatcaagcaattaaaaaataatttttcaatatacaaaaagaatattaaaaatttaacgaacttttttatatttataaatacttaaacctgctattcccacaacggaaaccaatacacctataatataataaaccatgttgttttcgtctgatgtatcaaccgatgaagaaggtttatccgttgaaatgttatctgatttaccttcactctttacactttcattatttttatcatcatcgttttgaatattataatttgagttatcatatccgcatacactgcattttccgtttacatactcgtgttcttcaaaaaccgccgttacaacaacatcgttttgaggcatcgtaaacgatgtttccttcgcattttcatccttaaagcttatctgagaactatccgagctccactttaaaaagtgtccgttttcatcattgtcatctgctttcaccgttacgctttgtccgataccataagaaccgcttcccgttcccttcactaccgtaagatttttcttctcaaaagttatataatctgcataccccatccaaacctgtgcgttcttatagctttccaagcttccgtaaggaacgtatattctattaatattatgacaatactgaaatgccgtaacattaacagtaggaggaatttcactgtttaaataaatagtttcaagtggagaacaaagataaaaagaattcaaaccaattgcctgaagagtatcgggtaatgttatttcctttaaagaagaacaatttgcaaataatcctgtttcaatggatgttatctttccaaaaatagttactttctctaaagatcgacaacgattaaatacccctccatccattgaaacaacactttctggtatagttatttcctccaaagcaatacactcttcaaatgcagaagcacctattgaaacaagagtgtccggaaacgttattgtttttaaagaagcacattgaaaaaacgccttactttcaatggaagtaattaaatactcgttcccattaatatctgctatttttcccgttaaatccaaattcgtaaatgttgcaccatcgttctttcctatggaaagttcgtttcccgatgccgttacgtttcttattaccaatgtatcatcttcactgttcgttaaagtttcagcattgacatcatatgtccaatctcccgttgccgcaaaacttatatttggcataaaacagaacataaacgtaaaacataccacagccattaaaatatatttgagtatttttttcttcattatttttctcatttaattttaatgttatatgttatgattattttaccatatcggctgtttatttgtatatcacccgtttttcataaaaaatgggtataatgactacacacactttaaatacaaattttattactgtatctcataaaaaatattttataaatcaaaacttcattttaatttataaaatataaaaaagagttttagaaatatctaaaactctttaaatatttatgcatcgacagtttcagcttcaagaacttcttttaaattcatatttgcttgagaaagcataagcttgattctgttaagctgattaacttcacttgctccagggtcgtagtctattgcaacaatatttgataaaggatacatttctcttattttcttaattacccctttaccaacgacgtggtttggaaggcaaccgaaaggttgtgtacaaacaacattgtttacgcctgatttaataagttctaaaatttcacctgttaagaaccagccttctcctgtctgattaccaacagatacaacatcatttgcataataagcaagtttatttatttgatttggcgcattaaagtgtacgctctttgcacattcttctttataaactttcctgtatgtttctataaagtttattcctaaattggatattgttgcgctgattttcttcataccaagtttatctgatttaaagttattgttatagaaacagtataataagaaatcaagaagatccggcataacggcttccgctccttctttttcaagtaagtctaccaaatgattatttgctccgggaaggaatttaacaagaatttcacctactattccaacttttggtttaacttcatttgtaattggaagttcatcaaactctcttataatatttcttatgttttcatggaaaacttttttagaagaacgaggttttgataaatcttttatacatttttcttcccattttttatgaagtaaatctgcagaaccttttactacttcgtaaggtctcattctatataacactctcataaacaaatcgccgtaaacaacagcctgcaaacctttgtttaaaagtttaggtgttattttaaatccttcgtttgtttctattccgtttgcatttagggaaattacaggaatatgtcccattccggcattttcaagagctctacgaataaatccgatatagtttgtcgctctgcatcctccacctgtttgagttatcattatggcaactttgtcagtatcgtatttacctgaattcaatgcttccataatttggccaacaacaatcaaagaaggataacaagcatcgttatttacatattttagccctatatcaacagctgttttactatcatcttgtaatgcttcatacttatacccacaagcattaagagcagcttcaaacaatgagaaatgtataggagacatttgaggagaaagaattgtataatctttcttcatttcctttgtaaattcaactctttcatagcttgatttttttatttttctctttgtttttttcttatctcttattttaagtgttgcaagaagtgaacgaattctgattcttgcagctcctaagttatttacttcatcaattttaagtacagtatgaatttttcctgcagaagataagatatcttttaccccgtcaacagtaacagcatcaagaccacaaccaaatgagttaagttgtacaagatcaatattatcttttgtctttacaaagcttgcagctttatataatcttgaatgatacatccattgatccattacaataagaggtctttcaacttcaccaagatgagaaacgctgtcttcggttaatactgcaataccataagagtttatcattttatcaataccatgatttacctcagggtctacatgatatggtctgccggcaagaacaatccctctctttcctgtttcatcaagatattttactacttcttcgccttttttcgctattttttctcttacgtttaaaagctcatcccaagctttatcaacggcttttgaaacatcatttttatctaagtcaaaacctgtttctccaccttttgtaaattctctaattattccttcttttattgtatttttatttgtaaatgcaaagaaaggatttaaaaatttaacattttcactttcgatttcttcgacattatttttgatgttttctgcataagatgtaacaataggacagttataatggtttcctgcttcaggtgtttcatctctttcataaggaatacaaggatagaatatagtttttattccttgtcttattaaatatgtaacatgtccatgagaaagttttgcaggataacattctgattcacttggaattgattcaattccatattcataaagttttctcgttgatacaggagaaagaacaactctaaacttaagctctttaaataaagtagcccagaaaggatagttttcatacatattaagaactcttggaatacctacagttccgtttattgcttcttcctcactcaacggttcataatcaaaagttatttcatttttatattcaaacaagtttatatcagtcgccttatctttatgtattccagcccctttttcgcatctgtttcctgttataaactttcttttaccaccgtcaaaactatttattgtaagatagcagttatttgtacatcccttacatcttgttgtaacagtagtatatgtaagtttatttattccttccaagtcaagcatggaagtttcttttccttcttcatatctttcttttgctatcaaagcagcaccaaaggctcccataattcctgcaatatcaggtcttacggcatcatgtcccgaaattttttcaaaggctcttaaaacagcatcattatagaaagttccaccttgaacaacaacgtgttttccaagatcatcaggatttgttaattttattattttatataatgcattttttataactgaataagcaagtcctgcagaaatatcgcttaccggtgcaccttctttttgagcttgtttaacgtttgaattcataaatacagtacatcttgttccaaggtctataggattttttgcaaacaaagcttcttttgcgaaatcttcaacgctgtaatcaagagatttagcaaaagtttcaataaatgaaccacatcctgaagaacaagcttcgttaagaagtacattatcaacagaaccattctttatctttatgcacttcatatcttgaccgccaatatccaaaatacaatcaacttttggatcaaagaaagatgcagcataataatgagctattgtttcaacttctccttcatctagcataagagctgattttaccaaatcttccccataacctgttgaacatgaataaacaatttttgcatcttttggaagttttgaataaatatctctcattgctttcatggtagtttccaaaacagaaccattattactgctgtagaaagaatataacaaatctccgtcttcactgcaaagtgcaagttttgttgttgtagaccccgcatctataccaagataacaatttcctttatagttttccaaactacctttttttactgtatgaacagcatgtctttttgtaaaatcttcataatcttccttactttcaaaaagactttccattctttttatttcactatttagctttatctcactatttaatcttgtttctaattcttctaatgtaatattttctttttcttcactgcttaaagctgcccctatggctgcaaacaagtgcggattttctggagatattacattttcatcttctaaattaagagttcttataaaagcttttttaagttcactcataaaataaagaggaccacctaagaaagcaacattacctcttattggtttaccacaagcaagcccgcttattgtttgattaacaacagcttggaaaatagaagctgcaagattttctcttgttgcgccttcattaataagcggttgtatatcactttttgcaaataccccgcatcttgcggcaataggatatatatttttataatccttcgcaagttcattaagtccgttggcgtctgtttttaacaatgaagccatttgatcaataaaagaacctgtacctcctgcacatataccattcattctctgttctattccaccgtcaaaatagataattttggcatcttctccaccaatctctattgctacatcggtatttggatgaaattttctaagaacagttgaaaccgcaacaacttcttgaacgaaaggaatatttaagtaacttgataggctaagcccacctgaacctgttataaccgggtaaattttacaatcccctattttatctaaagcctcttttatcatacttaaaagagtatcttgaatatttgcaaaatgtctttcatattttgaatataaaatattattatcaatgtccataatgactactttaacagtagtcgagccaatatctacacctaatttattaattgattccattacacccctcccaaataattatcatttattataattctttaaattttaaatagcaataaaaaagccgaaaattagaagcaattttcgactatttttcatatttatttcatttttatatcaaaaaatattatcttttacatgagcatacataacaacaaatgtttctgttgttccaaattgttgtgctccttcaagaagctctgcaaggtgagttgtacttgttacataagcttttattattagagaatactgccccgttaaataataaaattcgcttatttcacttgtattatttgcaaactccttaaattcatcatacttacttgcgggcatatctatggtaataaatacggttatcccttgaccaagtttttctctgtttattatagctttataagcagtaattattcctttttgttctaatctttttactctttcagcaacagcaggagcagataagccaagctcgtttgccaaattcttcattgtaattcttccgtcaacatttaatctttctagtatttttctatcaattacatccattttttttcttactccccggtaataatttgctacttataaaatatattacaacatttaattaaaataataaagaattttttttaaattactttattttataaatatttttttaaatcttctactttatctaatttttcccaagggaattcacttctgccaaaatgtccataagctgctgtttgtttataaataggacgtcttaaatcaagatgttcaataatttttgtaggtcttaaatcaaagttttcatttattatttcaactattttatcatcacttaattttgatgtaccataagtatttacatatatacttacaggttttgcaaccccgattgcatatgcaacttcaatttcaatcttttcacatataccgcttgcaacaatattttttgcaatgtatcttgccatatatgaagcacttctatctacctttgtaggatctttccctgaaaaggccccgccgccatgtcttgcatatccgccatatgtatctacgattatttttcttcctgtaagtccactgtctccttgaggtccgcctattacgaatcttcctgtaggattaataaagtattttgtattttcgtctaaaagattttcatctataacttcttttataacatactctatcatgtcatgtttaattgtatctaaagatactttttcatcatgttgtgttgatataacaactgtatcaactcttacaggcttatcgccttcatactcaacagttacttgagtttttccgtcaggtcttaaatattctaaagttttattttctcttacttctgttaattttaaagcaagtttatttgcaagcgagataggaagaggcatatattcttctgtttcactgcaggcaaaaccaaacattataccttgatctcctgctccgttttcttcttcatcttctttagcatcaagagatttatcaacgcccattgcaatatcgcttgattgctcatctattgatgtgataatgccacatgtatttccatcaaagccaaatttggctcttgtatacccaatatctgtaattgtttttcttacggttttgggaatatctacatatccgcttgtagttatttctcccattacaagaacaagtcccgtatttattgcacattcacatgcaactctggcatttggatcttgttctaaaatagcatccaatacgctgtcacttatttggtcacatattttatccggatgaccttttgtaacagattctgatgtaaaaaagtgtttattcattatttcctcccatttgtgaccttaaataaaaaaattctcataggaacctatgagattaactgccttcctcatcattcggaaaaatcccgtaggtattggcaccgtacaaactgtcggttgccgggtttcatagtgcctattcactccaccactctaaataaggtctattattttacaattggaatattaccatataaataatataaaagcaataatttattttattttattataaaatataaaaaaagctgttattaaatacagcttttctaaaatatatttaattaattctttattctaatataaaaaattaaaatttatttattgttttacattcgttaacggcagtttttactccctcaatatctcccccgctttgaattgtaacagctgcggcaataccaccttcaacaattggtccatctatcatataagcctcgttctcacacatatcaagtgccatttccgttgtcattacggcacttccaagatccatcattataataacaccatctccgctgtcagcttcagcaatgccgttcatgattttttccatatcagtaccgatacttccgtcacttaaacctcccgcagcaacaatttttacatcttttgccatttgtgcagcaagttcttttactccaagagcaactttttcactgtgagaaacaataaccatacctaacataagaatatcctccattattttatttatagtattatatcataattattaatataaacaaaaaaataagaggaaatcctcttattttaaagccataaaattataagtccacctctgcctgaatttacaactcttgtaagtgctttttgaacttttattttattgtcatcttcaatagatgtaagtttattttgcatattatcgcttatcatattttttaaatttcttccaaagaattcactttcccaaattttttcttgatcatttttatattcatccattattttatcataaaacacctgacattcttcctctgaacctattgtaggacttattgatgtttctacatttgtacatataatatgaagtgcaggagcagaggcttttattttcaccccgtgtcttgaagatttatttatcatttcaggctcatctaatacataatcttcaaactcaggtgtaactattccatacccgctgtttcttgcaacatccaaggcagatgctattttttcatattctctttttatattagtaagggatgagataagcataaataaatcggattcgttttctatagtaactccgtttttttcgtttagcattccataaaatacgctgttatttatattaacatcaatatgtataacaccaagactaagatctatatttgatatattcatttcaaaattatcaaatttcgattctttaattccctttaaaactttatttaaagtatcattcttatttgaatttgataaaataaaattatatatttccttgtttatttcatcttctttatctaataagtctgtccacaaaggaagagaatagttaatttctttaacagggaattcaaacaaaacatccaaaagaagattttcgatatcatcaagagtcatattcataacatctaaaataataactttacacccatacttttcttccatactcttacaaagttctttagacttactgcttgaaggattttttgtattaagaattgtaacaaaaggcttatttatgttttttaattcatttattactttttcttctgcttgaacataattttctctatctataccgcttatactaccgtctgttgttacaacaatccctattgtagaatgtttttctataaccttttttgttcctatttccgctgcttttttaaaaggcataggattttcatcccatggggttcttatcattctttcttcattttcgtccatatcccctatagccccctctattacatatcctacacaatcaacaagccttacatttaaatcaattcctcccccaagagaaatgtttgcagcggtatttggaacgaacttaggctcacaagtcattattgtttttcccgaaccgctttgcggaagttcatctatggctctttcctttttaaacttattatctatatttggtataacaagttcatccataaatttttttataaaagtggatttacctgttctaacgggtcctaccacacctaaatatatatctttacccgttctttttgatatatcttcgtatattcccaaattcataagaaaacctccaaactcatgtatcttacttatacatattcatttggaggttaaaatataattatttttttaattttcttgttttcttctgtatattaattttataggagaacctaaaaatgtaaaagcttctcttaatttgtttattaaatatcttgaataagcttcttgttcgagatccgggtcatttacgaaaataacaaatgttggaggtgaaaccgatacttgagaaaaatagaatatcttcattctctttgtaccttttgcaggtggattgttcatcattactgcatcccccattatttcgtttaaaaggccagttgtaactcgctttgaatattcttcaagaacctgttcaattaacggcattaatttatgtgttctctttttctcagttgcacttatgaaaagtataggagcaaaatcaaggaaatataaagaacttcttattttcttttccatttccttcattgtgtttgtttgtttttcaactaaatcccatttgtttattacaataataacagctttaaacctatcttttataagtccggctatttttacatcttgttctgttacgccttccatcgcatcaatcataagaagacatatatcacttctttctattgcccctattgctctgattgtggaataatgttctatatcatcatatatttttgctttctttcttataccagctgtatcaattaaagtataatttttaccttcataattaaatactgtatctatggcgtctcttgtagttccggaaatgttacttactataactctgttttctccaagaagagtatttacaagacttgattttcctgcatttggtttacccacaactgcaatcttggttctttcttcttcctctattccctttttgttttcagggaaatgagcaacaacttcatcaagcaaatcaccaaatccaagagcatgttcagcacttatagctattggctctcctaatcctaaatcataaaattcatatcttaaataatctatatcaaaagaatcaattttatttactgctaatacacatggttttccgctttttcttatcatatttgcaacatctctgtcagatgctgtaactccgcttcttccatcaacgacaagaacaataacatcagccatatcaattgctagattagcttgtcttttcatttgttttagaattatgtcatcactttttggctctataccgcctgtatcaatcaagaagaaactatttccgccccatgatgtatcagttataattctatctcttgttacacccggtgtatcttcaacaatagaaattctttttcctgaaatcttattaaataaagttgatttaccggtgtttggtcttcctattaacgcaacaaaaggttctctcatttttctcctccttttaactacttaatttatctatcattttaatgtcttcatcacttaaagtaacctgtactgtttcgttatccgtatagattactttaccttctttcattccgcttggtttctttacatattttatatatgtgtaatcaactggcacatttgaagaattttttgcttttgaataataaacacaaagtttacaaccaaactctaatgcttcattagaatatttaccattgtttgttcttattataacatgagatgaaggaatatctttagtgtgaatccataaatctgttttaaaagcaaattttcttgttaaataatcattatcaagagaatttcttccaacatatatctcatacccgtcactgcttttaaataccaacttctctacttcttttaaatttgacctttttttctttttctttatatatccaagctgttctaaaactctttttatttcttcaacttcaggatatgtcttagctctttctaaatatagggactgtgattcaaggaaataaacattctcttccccttctttaataagtttttgcaaatatttctttgaattttcaagttttgaatactttttaaaatatttatttgcattttcacttggcgataaggcaggatttagggaaatagtcatttcttcatatggttctttaaagaaatttaaaacttttacgcttttatctccttttttaatattatgaagatttgaaagaagcaactgacctttgatgttatatttttcactgtcttctgctttttgcaaatctttttttctaagttcaagtttatgttcttctcttgataaagtcctgtttataagattatatacatctttatatacaacctttaatctgttcatcctatcaatttcatgataatattcgtctatcatttcagacggagatgaaaattcctctttgtcaagattatcataggcttttatgtcaatacaaacatagtctttatttttaccatcttttttatataaattataagtaagcttattatcaagaccttcaaaatatttttttattgaacttactacattttctatatcatttttttccagatcatttaaacctacgtttttatctatattaagaccatctgttacttcatcaaaaataacgggacttataccattaaatgttgccattaaagctttttttaatgtagtatcccccttgctcattatattgtctatcgctacaaattcattaaaatctatgggattcaatctgtcttttgtaggatattcataatcaatcttaggaacaacttccctaagtaaaggattatcaggttttatgtgttttattgaatctattatctttttactttcatcatcaaccaaaattaagtttgaatttcttcccataatttcagctattaaagtaagattttgataatccccaagcaagtttatactttcaaaatgaattttaattattctatcaaactcataaccgtcaacacccgttataacagctcctgaaagatattttcttagaagcatacaaaaaccgtaaggctcattcatcgaagcattataagtgtttataaaatgaactcttggtgtagaggagcctgcatttataagtaacatttctttttcatttccaaaagtatgaagtactacttcatactttgtaggcatatatattttattaatcttacttcctataagtttatttttaagctcttttattaaagcataagttgtaattgaatcaaaaggcatttttattttctcctttatttgtttaacagagtaaattatatattaattttattttattagcaaatatataataataaatttttattaaaaaatcatgaggggttctatggggtttataagtttgtttttaatagctattggactttctatggatgcattttcagtttgtttatgtattggaatgagtaaaaatataaatgtaaaacaaatattaaaggtttcttttttcttttctttttttcaaggattaatgccgattttaggatatatattagcaataaatttcagtgaaaaaataagttgtattgataatattatagttttctttttactttcttttattggaataaaaatgattattgaatctttaaaggaaaatgaaaataaaaaatataattctctttcannnnnnnnncgtaagtatcgatgccttgggaataggaatttcatttgcgtttatgaatataaaaattattcccgcaataatattaattgcacaaacaacttttttaatgtccattattggaattttatcaggaagttttttaggaaaaatactaaaaaacaaaggagaaactttggctggaattatacttattattattggaataaaagcattatttgaataaatatacatatatatctcatatgtaaagataattttatatataagagaaccttttatatatgaactattatataaattccatataataatataaatcactgtaaaagtcaaaatgttgaccataaagaatatatttttaaaagataaaacagcaattaaatttcattttaaaagttaaagaaatttaattgttcttttttttataaaaaaaataagtagatgaaaatttacaattgacaaataattttatttttgttacattagttatgtaaaggtttatatttgtatttggaggaaaaaatgtataaagaacaaaggcaggaaacaattcttcaatatatatatgaaaaaaaagaagcaagtgttaaagaattatcaaaaatgcttggtgtatcaaacgtaacaatcagaaaagacttaatagagcttgcaaacatgggaaaaattttaaaaacccatggaggagcaacatccgtagaaagtatattatcaacggaaactcctcattatcaaaaagataaaacattcagagaagaaaaagaaagaattggaaaagctgccgcaaaattagtagaagaaggtaatacaattataattgacggaggttcaacaccttatcatgtagtacctaatattttagataaagaagtaatggttattacaaatgatgtaaaagcagcctacaaactggcattagattcaaaagctaaagttctggtttcaggaggctacatagaaaaatccgtattttctcttttaggctctacctcagaacatctatttaaaacaacacattcagacattgcttttataggtttggacggcatggatataaactacggagcaagtgtaaaatcatttacggaaacacctgtaaaacaagcaatgattaaaaatgcagaaaaagttgctgctgtaattgaccattcaaaattaaatcaaaaaatgcttattaaatttgctgaaatagaagattttgattatatcatcacagatgaaatgagtgatgaagacataaaagattacaaagaaagaggcgtagaagtaatcattgcaaaataaaaagaccaaaaggtcttttttattaaagtagatataatttttttcataacttttaactactatgatataattccataaaggaggtttttatatgaaaaaatttatcaataaacctgaaaatgtagaaaacgaaatgttaaacggaatcgcgaaaatgcatccggaatatgttaaaaggcttgaaggtcttgacgtaatcgtaagaaaagacaaaaaagaaggaaaagtagctttaataagcggaggaggaagcggacacgaacctgctcatgcaggatatgttggatacggtatgcttgatgcagcagttgcaggacctgtatttacatctcctactcctgatcaaatttacgaagctattaaagcaacagatgcaggaaaaggaactcttcttataattaaaaactatacaggagacgttatgaacttcgatatggctgctgaaatggctgctatggaagatattaaagttgaacaagtaatagtaaatgatgatgttgctgtaaaagacagcctatacacaacaggaagaagaggcgttgcgggaacagtatttgttcataaaattacaggtgcagcagcagaagaaggaagaagccttgatgaagtaaaaaaagttgcagaaaaagtaattgcaaatgttagaacaatgggagttgcaatttctccatgtactgtaccggcggcaggaaaaccgggattcgaaataaacgacgacgaaatggaagtaggtatcggtattcacggtgaacctggaactcataaagaaaaacttacatcagctgatgaaataacagctcatcttcttgattgcatacttaaagatttagactttgaaggaagcgaagttgccgtaatgataaatgattcaggagcaacacctctaatggaactttatattgtaggaaacaaactatctgacattttatcacaaaaaggaataaaagtttataagagcttcgtaggacattatatgacatcaatcgaaatggcaggtttttcaataagcttacttaaacttgatgatgaacttaaagcacttcttgacagcaaagctgatacacctgcttttaaaacactataaggagaaagaaattgacaaaagaaactttaatagaattaattaaaaatatagcaaaaaaaattgaagaagaaaaacaatttttaacagatcttgacagcgaaatcgctgacggggaccatggaataaacatggcaagaggatttgaagccgtagaagcaaagcttgataccgttaaagataaagactgtggaacaatattaaaaacagtaggaatgactttagtttcaactgttggaggagcagccggaccattatatggaacagcttttatgaaagccggaatggttcttgcaggaaaagaagaattaaacggcgaagattttataaaatctatggaagctgcaattgaaggcgtaaaacaaagaggaaaatcagataaaggtgaaaaaacaatgcttgattcaatgattcctgcttatgatgctttcaaagaaaacatagataaagatacaaaagaagcaatgaaagaagccttagaggctgcaaaagaaggaattgaatatacaaaaacaataattgcaacaaaaggtagagctgcctatattggagaaagaagcatcggacatcaagatcccggagctacatcttttacatatatgattgaatgtttatataatattttataaaataaaaaacctgacaaaatgtcaggttctattttaaggaaaagaccgcttatgcggtcttttttattagaataatccggaaatctttccattttcatcaacatcgatattaaatgcagcaggttttttaccaagacccggcattttcataacatcaccggcaagagcaactataaatccggcaccggctgatactgttaaatctttaattgtaattctaaatccttcaggtctgcctaacttgcttggatcatcagatagagaatattgagtttttgcaatacaaataggcattttatcaaaaccaagtctttcaaagttttcaatttctttttctgctttctttgtataatcaactccgtcagcaccgtaaatctttgttgcgattgcattaattttttctttaatagataaatctaaatcataagagaatttaaagttattttcttcttcacaaagcttaataacttctttggcaagttcttctccgccttctccgcctttttcccaaacttcacttaatactacatttacacctaatttttgacattcgtctttaattaagtcaatttcagcatcagtatcgtttacgaatttatttattgcaacaacacatggaagaccaaatacatttttgatgttatcaacatgtttaattaaatttggaagtccttttttaagggcatcaagattttcactgcccaagtcatttttgttaaccccaccattgtattttaaagcttttactgttgctacaataattacggcatcaggttttaaatctgctaatctacatttaatatcaaggaatttttcagcaccaaggtcagcaccgaaacctgcttccgttacaacatagtcacagaagtgttttgccatttttgttgcaataacactgttacatccgtgagcaatatttgcaaatggtccaccatgaataaatgcaggagtaccttctaatgtttgtactaaattaggctttaatgcatcttttaaaagtgttgccatagcaccattagctttcaaatctcttgctgtaacaggatctccgtccatgttataagctacaactatattaccaagtctttcctttaagtcagtgatattattcgcaagacagaagattgccataacttcacttgcaacggtaatatcaaaaccatcttctcttggagtaccgttaacttttcctccaagaccgcaaacaatatttctaagttgtctgtcgtttatatcaactgctcttctccatactattcttctaacatcaatattacattcattgccttgatgtatatgattatcaatcatagcagcaagtaagttgttagcagctgttagggcatgaatatctcctgtaaagtgaagattaatatcttccattggaacaacttgtgcatatccgccgcctgctgctccacctttaataccaaataccggtcccaatgaaggttctctaagagccatgattgttctataaccaagtcttcttattgcatccgcaacacctattgtagttgttgttttaccttcccctgctggagttggatttatggcagtagtaagaataagtttaccgtttttatcttcagttctttttaagacattataatcaactttagctttatatttcccataaagttctatatcgtcttcactaagacctattcttttggcaacttctcttatgtcttccatttttgcttcttgagcaatttcaatatcacttttgtaacccatttttattctccttaaatcttaattttatttttggtgtttttgtataaaaaatacaaaatagtactatcaagaaatatcataataacagcttttaaaattctttgcggaatcattgcaattgttgcataaccgtaaagctgaacaagaaatacagtgtttaaaatcattgaacacattacttcacaaaaaaacatgataagcaaaaagtgaaaataattcatttcaatgtttcgttttttcagccacattgcaataagtcccggaataactccatacattgcacttgtaagagtaaatcccaaatgaaaagctccaccatcaggctttaaaacaaattgtataaaatctgataaaaacccaatagcaaatccataaaatggacctaaaacaatgccggaaaaaatagtgggaacagtcgtaaaaccgattctgaaattttgagtaacagaaatttcaaacatcttaagaaccatccccattgcaataaacaatcctgcataagccaattttcttgtacttaccaaactagagcttgctctattcatacttttacctcctaagtattactagacaaagctccgctatgaaacatatttaattaatgtttttttacagcggacgcgacaagacaccgcaaccaataaggttttcgtttaaaggcaacttcccatcctttaacacttaacgcatcttatctactctgtatatatttttacataacgattatatcataaaaaactttatattctgctattttataaaaaatatattaaataaattgatatttaaatataaaaatagtagaatggagtaaaaacaatcggggtgatatactttttatggaaataacttttgataataagactctaaatggcaaagtatcagcaaaacctgtctttgaggatttaaaaagatatttaatatgctctttattttcaaatgacataagtataataaaaaatgttttattagacaaaaaaacaaaaaatctacttaatatattaagcaaactaggtgcaacaataatggtagatgaatatgaagggaaaagaaaaacacttaagataaaaggctcttatccttttgatgtaaatataaatcaaattgatgttgaaaataacataaatttattaaaaaccatagctccgatactccttgtttccaaaaagaaatttaatattaaatatcaaaatattttaatttcaaacccgataaattctttttatagtttattcttcaaaaaaggcttcactatgatacaaaaggaaaaaagagaatatcctataaaaattaaaacaagcatagataaatccgtattttttataagagcagatgttgaaaaagaatatctttcaacgatgctttcaattatcccaaaagcttacaataatgcaaaaatcattattcattcgggagaattaaaagacaaagaatatattttaaaaacattaaaaatacttgaaagctttaatattaaaattaaaaatcataattttaaagaatttgatattataaatactaaatatcaaccatgtgacgttacaatagaaaatgactttacgtctgccagtgtttggataacagcaagcgctctcggacataaaataatggttaaaaatctaaatttaaaaagtgaacaaaaaaacaaaaagattttagatattttaaagataataggtttcaatattctcgtaaataaacatggagatattatagcaaaaccaaataaaataaatgcttttaatatagatataacaaaagtgcctgatttacttccgtacctttcagttattgccagcgttgccgatggaacaagtaaattaagacatgcagatgaaatatatatcaataatactccaatagcagaagaaatgtcacgagtaataaatgaaataggcggtgatagctttgttttcggaggagatcttataataagaggaagagaaattttaaagggtggagaaataaaagaacctgttgttcacgaaattgttttttcactttgtgccatttcaagacaatgccaaaatcctattaaagtaactattccaaattcaaaaccgagatattataaagaattttaccgtgattataacagacttggagggaaaagatatctataaagccataaaatttatggcttttttttgtatgtttttattatattaacaaaaactaatataaaaaaagaggatacaaaatggatatttcaaaactaatatataacagaatagtacaattactaaaaaataagaatatgacaataaataaatttgcaaaaaagcacaatctacctgcaactacaatatacagcataggccacgggaaatcaaaatcaccatcaataataaacattgtaaaaatatgtaatgcactcaatataagcttatatgatttttttaatacagaagaatttaagtcaaaagaatacaaataaaactaccttttatggtagttttatattgtaatattctcaaattctctttttatttcttcttcactcatttcatcaagagatgttgaagcaatttcttctttgacagattgttcattataagtttttatatctttttcttgcttttctatttcaagctttaattcatctatctctttatttatatctttatgtccgcttcttttttcaatatcacttaactctttattaacagccttttccaatgcttcaattttactgtaagtttgctcaacttgctttattattttttgtaggtcgctatttttacttgaactttctgttttttctttttttacatattcatttaattcttctttttcttctttttgtatatttgattttatatcattattttcttcaatataagatatttcttcactatcaagaagttcatcatcttcttcatctattttagaagaactatcttcattgttcttagtatttatgatattatcatcaacttgaaaactatttatttcatcaataatattttccaaatctcctgtatgcatcatatcttctttactatgttcattttcatcatacataggaatatcaaattcattctcttctattgttttttgttttaaaggagcaactttttttaataccttttctagcattaatattcatatttttaccctcctttttatacataataactaaactatcatttaaaataatttatatcaataatgtttattttttaaattaaaataatctaaactttaaaaatatttaataaaacaaatcaaataaaaaaaacggtcaattgaccgtttgatttttagttattaaaatcattagaatctattgattttttattttggtttacaccaactaaatataaaataggaaatataaatctaattaaagatataatagaaacgccatatagaccatttaagaaaaatcctattatataatctaaaatcataattattattaaagcgattccccatttaaaacatgaatccataatttttttatcagtactcttattatgtacaagtcctgtaactgccgttgccatcataacagcagnnnnnnnnnnnnnnnnnnnnnnnnnnnnnnnnnnnnnnaatcaagagcaattatcccaaaaagccctagtaaagcaaatataaaagaaaatgctgaaagaattatcattattatacttgatacttttataagtgtagcaccttttgcattattttccattttgttacctctctttctttaagacagtatacttcataaatacaatataaacaatacctttataaaattttattattttcgttattttcagattgatttgtttcgtttatattaacttgattttcattagaataagggtttacaaaaatattttcttgatacattttttttgtatgtatgtttttatttgcaccttttataaaaataataggggctgcaatgagtattgcagtagtatatattctttccaaaattaaaagagaaacaaatgtatctaaaattatgcagataaggcttattatagcccaaaatttacattttgacataacctcttcatcagttacttttgcatttttaaaacccaaatatgcacagtatccttctattatacctattactaaaaagaatataccggcaaggcagtatattatagcttcattttgatatacaatatcaaaaatcattgttatatatccaaataacataaaaagccctgtaagcacattttgaatacatgcaaatataaatatagcagaagatgcacgtaaaaaatttttaccttttgcaaaatctatataattttcgttatacattttattccctctttatttataagttttatttcgtatattatatattttaagacaaaataatgcaaattaatatattaaagcccaacaaaattcttaaaaatatttgtaaatttgtaaaatatacctttattagcatttttatgtgctaaatgttcactgtaagaataagtttcattattaacattaacgctgtaatttaatatgtaattatcacttcctgagttatacactttcttataatcaactttgtactcttctccatcttttaagggaaaatatatatcattttctgcagtaagttttgtaataccttttttgctgtttttaagaggcagagtttttatgtattcacctttttcgataattttttccattttataattactaaaacacatattaagcaaatttttactgtctgtgtaatggtctgcactttttaatactacccccacaacctgcatatcatttctcttggcagcaaaaacaaaacacttccctgccttttttgtatatcctgtctttacaccatttgaaccatcaaaactatttaaaagtttatttctgttatatattactctacctttctcttttccctcatatgacatactccactttttatcatttattatttttacgaaattttcatttttcatggcatatgatgcaagaagtgcaaaatcataagcggtagtataatgttcatcgtcaggaagtccgtttggatttttaaagtttgtatttttcattccaagttcctttgctttttcattcatcattttggcaaatccttctattgaacctccaatatgataagccaccgcaactgctgcatcattaccggatacaagcatcattccgtgtagtaaatcttcaagggttaatttttccccttcctttaaatatatacttgttccctcaattcctgtatattccttttttatttcaacaatgtcatttaagcttcctttttccaaagctaaaacggcggtcataacctttgttgttgaagccatagggagtttttcgtctttatttttggaatataaaagcctatttgtgctgcactccaaaaccgcatatgcctttgaatttatactaaaggcctctacatttttttgtttaggcagactaaaaaaagatacaagtaaaacaaatacacataaaataattgatataactttatttttcataaaaccatctcttcccttttattctatgtttatttatatgtatctaaaataatttaatgttaaggataaagcataataaaccgttctttattacacaaaattttttttattttaatcatatctttataaaaaaaacataacttttaattaagtgaggaaaaagatatgttagataatataaaaacaagagtcattaaagaagcaaattatattgtagataataaatccacaataagaaagtgtgcagatatttttaaagtaagtaaaagcactgtacataatgatttatcaaaaaggctaaataaaatcgatatatcattatataaaaaagtaagagatattatagaaataaacaaagaacaaagacatatacgaggcggaattgcaacaaaagaaaaatatagggaaataagaaatgaaaagaaacaaaagaaagaaaccaagctttaggcttgtaagtgctgttttacttataatattaatatttacgtataaattttatattagagatatttatatagataagtttataaataaagaacagacaaaaacatatcaaggacttattaatctatgggacagccccacaagaagcgttataggaagcagctatggttttataaacaacgccatatataactttgaagaggaaagtgaactattacaaatagagcttagagagctttcttttgaaggagcaaagacacttgcaaacgaaaaagcacaaagtgaaaatcatcctgatataataagcaaatacatagaaaataccataacaaaaacagacaatattatgtacgataaagaatttgtaaattatatgaaagaaacctacggcataaaaaaaataaaagaagaggaagaaaggtgtatattcccgttatatggttcttttaacgttataataataaacaaaaccgcctttgaagaaatgggaataaaccttccaagtaaagattggagttacaatacttttataaacctaatcagagaaataaaagaaaaggatacaaaaaaagaaaaaataccctttgacatgttcgtagatgaagataacttttcatatatgaattttattcttgataacggatacgaaaatataggatataaaaaacttgaaacattaaaaaaagaacttaagggatataattgtttaaaaactaagaaaagcgaagaagatgttcattatgacttatataattctaaaacaattatatatgcaggaaatatggatgatgtgaattatttaataagaacaaaagacaaggaaaatgcttttgagtttgaagtatatccctatccttatgaaacaaaaaaagtaaactttatgcaaaatgtaaaaagttattatctgttaaatacaaaagatgaatcaaaagaaagggtaataaaaaattttatggagtatttatatcaaaaggaaggtgaaaatatacttaatattcaaggaaaaattccaatgtttaacgtaaattataatgctcaaaaattaaagtatccatatttaaaagattatataaatttagaagaatattattccacagaagatgaagaatttattttaaaacaaaaagatatttataaagaagtcaaaaatattttaaaataaaaaaagcaggtcagcctgcttttttttaaagttcatctattatttttttgttcatttcatcataactgtttaaatattctttactaaaaggaatattagtatactttaataagtctacaatcatattaaatacttcatttgacgtatatcctgtagtttgttttacatattcatctgttactgatttaatttgatgagctgctgtatttctgactttactttccacatctcttacttcgtttattttatccttcacatcatcattagtacaaaatccatcaattaaaaatttaaaatgaacgctttttaatgtatccgtagtattaaatttaccgtttaaagcattaggaccgtttattgtatctaaaacacggctgtctccgtttcttaattttccgtcagaccatttttttgttttgttatccataaatgtaaaatcatcaatatttaatccggaatacttttcaaatattcttatactgatttccaaaaataacggagaaattgcccttataaaatcggcgtattctttcttttctatttttatttttaatgataaaagatattctataatatctctgtcttctcttctatttataggaagaaaatgttcgttatattttgaaatatatcttgtcatatttgcaaaatcaagttgaagtcttctgtatgccccatttaacaagtccataaatttatcacttataaactctttagaaccatttgcgatatctatggcagaagaataattatattttctaatttgttcctttataatatcggctttaatttgaaaagcaaggtttctttttttagatttcttacatctattttcaaagttttcctcgttatctatattacattcccacataagttcaacatcataatctttttccattccgtcattcattctttttactggggtagaaacctgtattggaatgaggttttcttccccaagaacagatagaatctgaacagagcttttcattgcaggagagcctgaagaaacatttacatatatttcactctcaggattttcttttcttattctttttattatttctttaaattcatcaaaaaagtcatcaaaaatatgaacatccacaagatttggtcttttaataagttcgtattctatgttcttttctatatgttttgaaagaagttcaagagttttagtgtatctatggtctgattcttccttttcaaccatttcctttgaaagatacatataaactttatcaggtttaaacactcttgaaatatgtataaaagcaccatcataagaccctcttatagggtctgttcctcctattggcgtgaataaaatttttttcattatttcctccattataacgtccctgcaatagggattgttttggaaaacacttaaggataaaagatatatctttggtggttctcgtcccttttatagggatttttagacttacgcagcaattaaaactgcacaaaaagacacgatttcgtcccttttgtagagattttttattactattatacaccttaaagaaaaggataatagatatattcgtctctttttagagattaaaacaaaacatatataataatatacgtttattttatcaatatattaattaatttacaatatataaatatttaatacataactataaagtccctttaatagggatttttcattaatatcgaagtacataagttaaaagaatagtgttttcgtccctatgatagggattatttttttatggacatttttgaaatgttgttcacagcacaaaacgggttttcgtccctattatagggaaaagttagggactctgtccctataaccctgctctttttttgcttgtcccaaaaaagaggtaaaaacgacacttctcggcgaagtgccttattacgcttttcgatgcctacgtaaaactctcccaagttttactggcagaaaagctaccccaaacctaacttaatgaggggatatcgttaaacattaccctaacaaataataaaatagggcggcggtagcactcgttcatagaaaaatcgggtagatttttcatgaaatccgagtgcgttataagcccccacggcgagtggcgcccttttattcgacttttttaggcgagtaaaaaagtcgtggggtttaggggtgaaacccctatctacgtccctatgatagggattatttttttacagttaatttttatgtagttaatagcaattttcgtgttttcgtccctattatagggaaaagttagggactggccctataaccctgctctttttttgcttgtccattcgcaatttttcttaaaaaatcgctcatgttgtttaaagctttcagcttcctgagtttttataaaaactcagctgtttctttgaaacagtaaacagtcacaataagaggtaaaaacgacacttctcggcgaagtgccttattacgcttttcgatgcctacgtaaaactcttcccgagttttactggcagaaaagctaccccaagcctaacttaatgaggggtatcgttaaacattatcctgacaaataataaaatagggcggcagtagcactcgttcatagaaaaatcgggtagatttttcatgaaatccgagtgcgttataagccccacggcgagtggcgcccttttattcgacttttttaggcgggtaaaaaagtcgtggggtcttaggggtaaaacccctataacaacatttttatacaccccatcccctgaggcgacttaacacctatacctgcataggatgcaaaatcaaaaagcaaatgagttagacttaacagaggttttggaccttttacataaaaacttacgttacctataaaggatttaattccaacatcactggatttgaacatagtgcttttaatgttaaaatcctttagtgaaatattatttattatagtttccattgtttcttcatcttttaaagtaacaggtaaaaatgaatcagccttgtttaccatactttttactataagcctaatatcaggaacaaaaacattttctccaaaggatttaaaacttgtgggggttacaaattttacttttattaccttgcttttttcctctttataaaaggaatttatatattcgtttaagtcttttatttctttcagattatattcatatggaatgtatttatggtctttataagtaatattaataaatccctctttgtttaatctttcgattaatggcaagataatattttctcttgcttcttcatttaatgtatttatctgccatatatattcatcattatttagcataaaaacactttgagaataaggttttaaaccttgaagatgtagaaagtctgcatattcttttttgcatgtttccataatatacccgtgaaacaacggtgcattgttataaaaaagaggaaagccctcttctttttttatttttactgttaatcttgaaatcattccaaaacctctactattccgcaaagtcttgtgcctttttcgtttgttacgactttaagtgttcttggactgtaatttttatcgtttatgtgttcgctgatttttttcattctaggatttttcccatctttatgtatcgcttcttttgttttatctattaattcatccccctcatatgcaccttttaaaatgctttttgaatgatatccaaccattcctccgataacaaacaaagcatttttattattataattaggtaaaaacttttcttctttatttcctatttttaaagtatttaaataaagttcaaaacctttttttaaaatatttaagaagtcttcttttgattttaagtttataccgtatttttcatataaaaggttggtttttgccttatccaaagtaacactgaaagaaaacacacttccctcttttatgaattccttaaaattgcttatagttttagattttccatttatataattataatcttctctttgtaaaacctgtatagaatctttttttatcttattagaatcggaaatcataaccccgctcataatctgcaaatcgtcttcttttaataaatatttctttacagcttttggatttactttaaaatcatttaatgctttacttgaattatttagtatgtagctttcaagaactgttctaaaagctcctttcaaactgcttccaggtatataagggttactgtcaatatctttaataaataaatctatttcatttagatttgtttttgaaatcttgtttttataatatttagccctgctactttcaattaatgaataatctattttatttaccgttcctccttttattaaaatatcgaaaaattcctttaaagaagccttatcattttgtagtaaaaatttattaaattcatttagacattctatctctttaaaatactttataagttttcttttatctataaagataacatctttgttattaagcaaataatcgagtttatttattttttcaccgcttccgataaataaaggagacataactttacaatttagtgtgaaatttacataatcagacttcattattctatcccccattttagtgcttttgcatatctgtaaatgcttcttatattttctttatttacttcctttatcttccctttaatatcaaaatccatacatgaaccgctttttaacattggtgttgttttcttttttaccatatttccatttacgacagaaaatccgcttcttgaaataacggaataaaaactatttgaagttttaagcatcatgacttcttcatcagttggaataacactagataaaagcattttatatttacaatttgaatttaaactgtttattatatattcatttggtttcattatttcatctatttcaaatttaccgtatccgcttgattttttaccccctataccactaaaagaaaggcttttcataacattatcaaactcttcttttatttcatccttaaaagaaacaataaaatataaaccgcagtttttataaaactgtattccagaaacagtgtaaggagtctgctcttttgaaaaattatactttgtttgataaacctctttaaaaaatggtttagaaagtttatattttaaaagatcattaccgttttttaaatcattaatatattcattaaattcattcatttgaatatattttatcttcttacctatttttctgtctttgttcttgttttccaccaaactatcaaatatcataattggctttggaagataaagattatcttccataaaaggaaataaatcacttatataaaaatcattaaggagttttttcgctttatctataccgtatagatttacatattcattaaaaatacttgcaaaaatctggtccgaagtaaaatcggaagaattgtcatttgttatatttccctttgtaacaccaaaacgaacaggcgttacaaacttaagtttataaatataatagttcatagttcaccttaaaatacattttcaataatagattttattttttcttcgttttcctttgttgcaaacattatatcttcattttcaatgtttatttttactcttccgtatcctcttgtaccgtttcctccaagataatccatttcaagaatatcaaaactatcctttaagtttttaatatcctcttcaaattcatcaatactttcaacattataaataagcttaaaatcaaattttgcaccggcaggaacacgttcaatttgtcttgggtttgctactgctgtaattctatcaattgtattttcaaattttgcttctgttacatataaatccgtatcggcatttttaagcatttcggcattttcttcatttaactttaaatcaaaaaattgaagtcttgatgacactatttgattatttgaattaccgcttccaaaaagtctttttatggtaatatcttcatcgtcaattttatttaaaacagaattttcactttttattcttgaaagaagatatcttagttttccttttaatgagcttccgggaatgataggtaaatttgttattgaatcttttattacagaattgtcaatggcacctattgctgcaaagtcatcacttcctcctatgtgaagccctgttaatatatccaaacttcctttaaacattatttttgcatataacttattcattttcccctcctacttgtctcttccatagaatttttgataagcaatcaaagcttcagtataatcaaaaaagttatccatgtcttttactgtttttattgtacttaaatataaaatgaaagatatttttttatctttatactcataatgtggtagtttattgataaaccaccataaagcagatttattgtttatttttttattttttatttcaaaatcatttggtttaactcttccgcactggtaagcaacctgcatttttaaatattctaaatcatcaagaattttatcgcttaattttccatcaacaatattaccgttcaacttttccatttcatatgtatttttcaaattgtttatttgtgaaaaaatctttctaagctgagtagttgtaggtaacattgcgtttttctcggcaactttaataagattctctgctctttttatatcctctctgctcatttttattcctctctttctctgtttaagtaaataattaaaattattgttgtaataagttttttaatgttttctttgctgttaatattatctataattaaattagtaaatttattatagttttctctttgtgctaaatttttaggttcaatcattgcaagagcataagaaattctcgcaagatttatgctttccttactatttctaagtaagtttaatagtttatataaaaatccgtttcccaaatatattttatcttcacatttttcctcttcatcaaagaaacagtattcgttaaattttaaatacaaatttccataaatatcgttaataaattcatcccacttatatacattgttttcatcaaataatgtaatgctgtcttttgtgttttccttagatatttcaagcaaatttgcgcttaaacttgccatattatttataggaagatttgcatcgtacattccaaaacctgcacttatgcttaacctttcattagagaatattttgaaatactgtcttatatttattgaaagatccaatacttcattccatgctccaacaataaaaagatcatctcctcctgcatatattattgaaatatttttaagaaaatctttatttgtaaaatataactttgtgtctttataacctgctattttatttagatagaacttaaaaaacattgaaagcattgaagacaaactttgaaaacgtgatattgtagcgtatttatatttatcttcaccttctttatcaaatccttttataaatgcacttccaaggtcgtcaacgtccattcttagaactccaagcctatttataccaatacttcttttagataaatcagagaatgaatataagctcttacctttgaatctggtataattacccatccaaatatttacgcagtatttaagtcctatcattgggttatttattgaatatcctcttataatctggttattattgatatcattaataaattcatttttattctttaagtataaataattttcaccatcaagagaaaataaactaatcaaagaatctttatcttttttgtttgatatactaaaaagcatttcatctttcattgtatcaactctgaatattccctctccgagtttatacatactctcacagctttcgcataccatatttccaagatcttcattttcgtgtaaatctttataagaccttttacacacactacattctcttaaatctacatcgttattagtatacttactgttatcattaaacaattcatctaaagtatttttgtatctatttattttatcttttgaaatttcatgacctgcatttttatatattttagataaggtatcattactgtttatattaattaattcattagcagaacattcactatatccaaaggcaatatataaatctatgtaatattttcttaaaaaataagaattaattttgttttgaagatattttattttatcttttgtttcctttgtgtttgcaagaagcatataaaaatgacctcccccgttataaaggagatttgctcttgacaaatcaagataatttaacatttcatctattatgttttccatttcaatttcaagatagaaagaacgacctttaattgaccttaaagccccttttgaagaaatattaaaaataaaatcttgtataccagataagtcaccgcttaaaagaatcattgttttttcactgtatatattttcttcttcactaaaacaacattttttataatctgttattcctttaaagttaaagtaatcaaaaaaacaactggctattgcggcagtaagttttgaatgtgaataaagagagacatcatttattccgtttttgtcagtggaagcagggataaatgaaaatgtactttcaataagttgtaataaagaatttacgttaatatcattgtttgtaatatattcaaaatttttatcaaaatattcaaaggctttcgaataatcatatttgtcggttaaatttctagccgtattggtatctttaggcaaaagaatatctttttttatatcaatatcagaaacattaaaagcacttataatattattcttatttgtatttaacagattaaaaatattcataagtggagcttttttatcatatccaaactcaatatttccatcatctttttttcttctgtctatggcagatgaaatgttatcacaaacatatgttatatatgaaaaatcatcatttgttaaatttgcatttgtaattttattcttatgatgatacaaaacagaatttaaaatcttatcatttgtaattcctttttcttttaaataattataacctaaaagagaatgatttgttttttcgtttgtactcctcataatgaatttccccaaatcatgcaatacggaccctattattaaatccttattcaaaacatacctcccatttaatcgtaaatattttcttaattataccatacagaaaattgactgaaataaaaaaataaattaaaatatataaaatattgataaaaaggaaatttttccctattatattacaatttttatatatataatgaaaacaataaatatatattatataaaacatttccctacattaaaatttcattaatattttgaaaaaaaatgtaatatatagtatagttattatatataaataagaaattggaggataatatggcttttaaaattattacagattcggcaagtgatattccacaatatataatagatgaatttaatttacatgtaattccaactcccgttgttataaatgaaaaagactattttgatggcgaaacaatttttcccaaagacttttacagcattttagaagataaaacaaaagatattaaaacgtatcatattaatgttgaaatgtttaaaagaaactttgaaccttatgcaaaaaacggcgttgaagttttatatatgtgcttttcaacaggtatagcaggaacattcaatgcagcaaaccttgcaaaagaagaactgcttgaaacttatcctgactttaaaattacaattatagatacgaaatgtgcatctttaggatttggtattcccgtttataaacttttattaatgcaaagaaacggtgcagacaaagaaacaattataaaagcagctaaacatttctgtaaacacatggaacacatcgtaactgttgaaacacttgattatttatacaaaggtggtagactttcaaaattatcttacgttgttggcggaggacttaacataaaacctatgattgaaattgacgaaaacggttctcttgttgcttatgcaaaagtaagaggaagaaaaaaagcaataaataaaattatagaagaagtcggaaaaagaggcaaagaccttgaaaatcaaattatcggagttgttcatggagacagagaagaagaagcaaaagagcttgcaaatattttgaaagaaaaatacaacgttaaagacgttgtaataagttatgtaggttgtgcaataggggctcatacaggtccgggagtcattgccgctgtttgcgaaaatgaaagcgacggtgaatttaaggaatacttatataaataattatacatactttagcccaaaaaaatttgggcttttttatgttaaattgattatagtaaatttgttttattattaaaattttatctattaatataataaatgtatttttttaaatataatttatccaaataaaaatatctaacatttaaacatattatataaccataataaaaaagacaaaacatatttatgcaaatgtttcatcttttttattactttacaatgttctcggaagagtaactataaatacagttcctttattttccatactggatacctcaattgttcctttatgtaattgaacaataagttttactataaaaagccccaacccaaaaccatcgttattatggcttgaatttacctgataaaatctgttccatattttatttaaatgttctttcgaaattccaataccgtcatcttcaatataaattttaattagtgaattgtcacagcttaaagatatatttacatttccgccttcccttccgtatttgattgcatttgaaattaaattagtaaaaagctgtatcaataatgtcatatcgcctatatattcgatttttcccaaatgatccattaaatttaatgtaatttctttttcctttgcatcttcttccatttcttccataaccgactgaactaaaacggaaaaatctattttatcataatttatttcataattacttttttccaatctggaaataaccaataatgcatctacaagatttgccatatgacttgtctttttatgaattgtcgttacatattttttctcttcgtcttccaattcacattcttccaaaagatattccgaatttgataaaatgacacttatgggtgttctaagctcgtgagcagcatcggatacaaattgtttttctatattaaaatgttcttcaagtttacttatcatcccgttaaatgatttagataagtatgacaattcatcttcttttcttatttcttttattcttaaagataaatcctgagaatttgtaatttcatttgcagtatccgccatttcttttatgggcttgaaatactctgaaatcattctataccctatcaaagccgtaaacaaggttaatattggagaaaaaacaaaaaaccattttgttatattgtttatcatattagcaacagaactgtatgaatgaatacctcttatccataaatattcattcttctctcctgctcttattttctcatcatatatataccaataatcttcgttttttgaaagagaatgtatttccttttcatcaaaaggataatcctgaggaaaatcatccgggactattccgtttatatattttccgtcatttgtatataaactcagcataacaccgtcatcataataagacataagttcgttatccggaaaataacttgaataattattcatatcttcttttaaatctccgacttcatccattaactccgttctgatattatcggtactgtaatattcggaaataaaaagaaacccgcatatagtaaccaaaaatactactatgataattcctgtataccaaaatgttattttattttttatcgttttggtcttgttcatcaacttcaagtttataccccattcctctgacagtttttatcattttattcccacatatatcatatattttttttcttaaatatctaatatatacgtctactatattagaacccccttcaaatctgttgtcccatgcctgttgctccaattgttctcttgttaaaataatgtttttatgataaacaaaatactccaaaagcatatattcttttgctgtcaagtccataattattccacagcattttactattctgtttcgtgtgtcaatagttaaatctcccgcatgtattatattattcttttgatttgtacttcttctcaataaaacccttaatcttgcaagcagttcatcaaaagaaaaaggttttgtaagataatcatccgctccgtaatccaatccttttaccttatcttttattttatcttttgcggttatcataattacggacgtatccaaatccgaagctcttatatattttaaaacctcaaatccgtcaatttcgggaatcattacatccagtaaaataatatcataagaatatacacttatataatctattgcttccctgccgtctttacaataatcaacagtataatatttttgaagtttttttgtcataacttctcttaaatcatcttcatcttcaactattaaaattttcaacttatcatcactttcttttcattttaatattcacttaatgattttattgtattatctatttataaaataagtcaagtaaaaaaggagtaaagatatgaaaaagaaaagattatttttaactttggcaatcggcttgattctcatatctgcgtttgcattatttaaacaaggcaatattttaaaaaaagaacaacaaatcggttctttaataataaaagtaaatcccgaaattgccatttcatatgacagcgaaggaaaaatcattgatgttacaccgataaacgatgacggaaaagaactgttaaaagattacaatgaatatgaaaacaaacattcaagaacagttataaaagacattataaaattgatgtccgataaaggctatttaaaaaacggggcaaatgctaaagacataaccgttacagttgaaaaaggttcaaaaatgccaaatgataaatttttagattatataatttatgatgttaaagatactctaaaaaataacactacaaacggacaaataataatcgaaggtgaaagtaattacggtttaagcgaatatcaaaattcaaattacggaaaaacaaaaacaacgaaaaagaaaacaacaaaaacaaataacaatacaaaatcaacaaacaattacaattcaaacaataccaattataacaataatacaaactataacaacaacagtaattacagtaataaatcaaacaacaacagttcaaattacagcaagccttcaagctcgaacaattcaaattataataacaactctaattataatgataacaattcaaattataataacaactctaattataatgataataactcaaattataacaacaactctaactacgataataacagtaattattcaaacagcaattatgatgactaaaacaaatttttatgaaaaaaagaacttaaaatacagacatgaaataaaatatcaaattaatttcgcagaatattttattctaaaagaacgcttaaaaaaagtatttaaaacagacatatatgctgctccacatggttattatcatgtgaacagcatatattttgatactccttatgacaaagctctgtatgaaaaaataaacggaacggacaaaagagaaaaatacagaataagattttataatcaaaatatggattatataaaacttgaaagaaaaataaaagaaaatcgtcttacttcaaaacaatcttccttactgtcttatgaagaaacaaaaaaaattttattaaaagataatgactttttgttatattcaaacaatcctttgttaattgaattgtacagtaaaataaaaggccaggggcttatgcccaaaaatattgtaacctatagaagagaagcttttatatattccccgtcaaatgtaagaataactttagacagcgaaattcaatcaaaaaaaatttctgcagaaagtaaatgtttttacgaaaagtataattatataaaaacattcaacaataaatttattttggaagtaaaatatgataattttttaccggaaatcgtaaaaataatgttaagtactttggataaattaccgatttctttttcaaaatatgcttcatcaagaatttatgaataggagaaattataatgacatttcaagatatattcaaatcaagttttttaaacaacattgcatcaattacggcctttgatatgatactatcgtttctttttgctttttgtttggggattttgattttttttgtatataaaaatactttttccggagttatgtattcttcaagttttggtatttccctcataggattatctttaatcaccactttggttatgttatccataacaagcaatgtcgtattgtctttgggtatggtgggagcattgtctattgttcgtttcagaactgccataaaagaacctatggatatagtttttttgttttggagcatagcaataggtatagtaatagcagcaggtcttattcttttggcggtgtttggaagcatttttattgcttttgtattaattgtttttgctcaaaaagatacattcgacaagccatacattcttattcttcactgcagtgatgaagaaacagaaaaagaaacaatgaaaattataaaatcaaaagtaaaaaaaatatcgttaaaaagcaaaaccgttacacccgacaatatagaattaaactatgaaatcagaatcaaagaagaatccactaaatttgttaatgaaatagaaaagaaagaaggagtaaacgcaatcacattagtttcttataacggagattatatggggtaaaaaatgattaaaagtaaaaaaatagatttaatatgtattatcataatttttgtttgcgttatattttcttttatattgatatcaataaaaaatttaggaataaaatcttccactattcaacaaccatacgtaaacaaaatttttaatgatgaaaaagttcatatgatagaactacatataaaagactgggataaaatgattacagaagtttctgaagaatatgttccttgcaatgtaaaaatagacggagaaattttcaataatatcggaataagaataaaaggtaacaactcaaaacagttaatagaaaaatatgggctgacaaggtatagtctaaagctggaatttgaccattacaacgattctaccaattactacggattggataaattaaacttggattgttcttttcaagataacagctatatgaaaacatatattacctttgacatgatgaaaaaaatgaatatccccacccctctttgcagttatacatgggtaaaagtaaacggagaagattatggtttgtttcttgcagttgaagaaccggaagaggcttttgctttaagagttttcggtaaaaatcacggtcaattgtataaacctgattataaggacataaatgaccccaatttagatgttgcattaaaatacacaacagatgaaattgatgaatatgacaatatattcagaaacgcaaaatttcaatgttcaaatcgagataaaacacgactgataaactctttaaaaaatttatctgaaaaaaacaatatagataactatgtagataccaacgaagtgttaagatattttgtcgtacataattttacggttaatcttgacagttatctcggacagacaggacataattattttttatatgaaaaaaacggtaagctaagcatgataccatgggactataatttagcttattgtacgtattccctcggtatgccaaaccctataaacgattcaactttatatgtaaattatccaatagatactcctgtttcaaatgaaattgccataaatcgtccaatgttttacaatttaatgacggaagaagaatactataatttatatcatttatactttaaggaatttatagacatttattttgaaaacaattattataaagtaaaaataaaagaaactcaaaatttaataaaggattatgtaaaaaaagacccaactgctttttgctcctatgatgattttaatatcgcagttaaaacatttgaagatttttgtaatttaagagcacaaagtataaaaaaacaacttaagggcgaaataccttcaaccaattacggacaaaataaagacaaaaacaattttatagacgcatcggaaatttggattcctaatttgggagaaatcaatgacttaattgattgataattcctttaatatttattataatggacgtaatataaacacataaaaactttatcatataaaaaaggcacctaaagtgtcttttttatattctattaataatttattttaaaatcccataccatcgacaatgctcaaataagcactgttcatccccgaatttacacgtgtaaaaagtttgtttgttaaattatatgtatcgctgcaatgccaaattccttcgcttttattaaaagttaggttaaaagaaatatcacttgttttattgatattactctcagttaatttattatagttttctatgagttttacaagatattcctcatcactaagcttagacgactgattttgattaattgtttcgttaatagccaaaataaaaatatcttcatagtcaggaacatataaggttatatttatttttgcactgcttccaattacatcaacactattaactttataatctacgtttttaagtgtatttaataacattgtatttatttctgattcactaagattattttgcacggaagaacctataaccatatctgtaaagtctttttttatttctcttaaatcactgtcaaatccgcttatatgttcatttgtatttgaagaaagatatttttcataagtgttttcactatcttttacaaatataacatctaaataattttttattttatcttcactacttcctaagttttgagtaaaataacatacaaaagaagcaagaacaataaaaataacagcaaaaatagtagcttttttactaacctttatattagaaaatatattctttttatcagataaattatttgtcttttcaagaacctcttctctttcctctttctctacttcatcaaaaaactcatcaacttctttattttttccactattttgttctatatttttatgaggatcattttgtttattattaaataaagtatattcagcataaaaatcatcttcttcagatgaaaaatattcttttaatttttctgagtcatttagtttattattgtttttttctttcattgtctttccccttttgtatattttaatcaaattaccataaggggtcaatatacaaatttaatttgtattttaaatataatttacattaaataaatgtaaaactttcataataaaaaaagaggcaatacctcttcttttaatacatattttggactaacttatcaatttcgatcatagattgcctttcttccgtatagctccatgtaattacagcattatcgcctttatattcattttcagcgacaaaattattgtcatactcaaggtcatataattcagccattatattgtcataatattctacatcatggttataaaaacccgataagcttccgtaaattatattacaataagcagccatcatactatccctgtcataaagctgatttgcaatatcatcttcattttttggttttacttctatccagttataaccgatatttatatattctattttattttcttcatctaaaagaaatacaatattaatatcaggttctttatccatttttactgtgcagtgataaaaatgatacccctctcccgcagtgcttgcatcttctaccgtaaaaccttcaagattaggaatttcataatctccccatttattatcaatcattgtaatgttatgattaataattgcaataaaatcatctttatctatttgaatttttccatcttcaataggaactccatgtttttgatagtaagaaattgaatttttgtaatagctattcataaacattccacatgcaaaaactataataacaagaccggctattaatgccataaatcttttatcacttttatttttgattttttgagtttcctttttaacattactttcattaataaattgattttctcttaatttgtttaaatcaacttctccgctttcgctgcttaaattaaccaacttacttaaagcttctttttctatatttctctcttgtcttactttatttaagtcaagttccccactttgagcttttaaatcagtgcttttttcaacaatattttgttcttcattctctttacttaatttattaattttactacttttattattctttacagtaaaaattgcacttacaaccataagtaatgctccaatccataaaagaatataaaagtcaaaaaactccattatattaacaaaaaaaatagggccttttttataatatatatctatataaattaattcaacaaaatatttccccataaattgagctaaaactaacaataaaccaacaataaacgccggtgcagataatattttctttgccatttcccttttctccctttttattatttatatttttattttaacatattttttattatcctccatttttttatatattctaaagctactatataataattaaattatttactaaattatattataatatatacccttttaaatagtgcattccccatatttaaaagggttttaaagcttttaaaattgttaaaaatcttctcaatttctaacaaattttattaattttttaaataaacaattgacatacttaattaagtatgatataataattatagaaattaggaaagaaatgaaagatgaaatatcagacattataaatttaatgacagccatagttaacctagtagctgtcatcaaaatttataaacacacaaaaggggattaaatccccttccctttctaaattatacatctttcttttttaaatatcaatggaaaatattactttaattatatccataattgcattagtaataagcatttacaatttaattagaatatcgaaaaacaaataaaaggagaaaaaaatggcggaaacatcatggcaagtaaaagcaaaatataacaaaaaggcgtacacatctttcagcacccaaatcaaaccagaattattcaaccgtatcgacagttactgcaaagaaaacaacttatcaaggtcacaatttttaacaaaagcgattgacttattagaacaaaaaaaataaggggctttaagccccttttattattcccctatcttctcatcagtaagtaaattctctctatacttatcagcttcaatagcctcttttgtaaaagagttgtttttccaaaatgcaagaaccgccgaaacaacagtagttaaacccgttacaactgtgtaaattgtgttttcgtcaatatccaaagatgtaaaaccaaacatacctaaagcactgtttactaaacttacaaataaaaaaagagtccttgcaatagtaccgcttgaaacattttttaaatcaatatttttcattattacctcctgttatattttataattcatattaaactttaaaactatctttaaacctctccatacgctgtcatgatgataataggtgaagtttagtaaatcttagttatatatctttatctcttcaccatgccccactccctaacataaaacccattcaaagtaattattttaatttcactattctgtccaacaccctaaaataaaaagcattaaaagtataaatttaattttgttgtcatgtcccactccttatgtaaaaccattaaaaacaaaacctaaatttcattataatgttccaccctactaaataaaacccattcaaaataattattatcatttcacaacaatgtcccaccccactaaataaaaccaataattaagttggggtggcggtagcatcggttcataagaaaatcgggtagattttccatgaaatcccgatgcgtctaagccttcacggcgattgagtgaaagcattttgtccagtattttttgctttggaaaaatactggtcgctctttagagcgaaaccctaaaacgccacgcccagtagcgtccttttatgtaaatatttgggcgagcaaatatttggtggggttcttaaggggtaacaccccttaatatcgggttgttaagggcagacagggttaggggcaaatccccttataaattacacattaatatgaacagcattacccatattagctgttccatagtaactatatgctgcccccaaagaatatgcttttgattttatttttgccttatcaataccagaaatataaatatccgctgccttaccttccatatgttttgaagttgaagaagaaccgcttacttctgcattgtgttttttacatctaagccctgatgtaattgttataggcttaccaaaatattctcttaattcttctaaaatatcaataagctttgaactcatctcagcggggtatccattacaatacttacccccgcactgacatttaaactctgattttttaaaatacttaaccttatcccaattcacttttgaagatgaagaacttgaagaagatgtattcttcaaagccttaatagtattacttcctgcaataccgtcctgagataaacctttcttcttttgaaatgacttaattgccgaaacggtcgcatttccaattattccatctactgtaagttttgctctatttttattaagtaaagtttgtaaattctttatgtctgaaattaatgccgaatctgtcttacttccataaattccgtcttgtgtcagccctttaaacttttgataactctttactgcagaagtcgttttacttccgacttttccgtcaacacttccggtataaaatccataatagtattttaaattagattgataattttttatgcttaacactaatgtccctccttattttcaagttttattattcttaattcatgttcatcaagtatcttgtcttgcttttcgttatgatcccaaagtctttttctcttcattgccatttcttctctactttctttaaattcattttttaaatcttttaaaacatcatttaagtgatttaaagaagtttctatttttgtaaccgctcctgcaaatctgcttatattgattatcacggttataatcagtcctataagagcaataattattgttatttgtccctctgtcatctcataaaatcactcctttattttttattaaaaccactaaaaaaaatttctctaaggggtttcaccccttataccccaccaaatatttgctcgcccaaatatttggataaaagggcgccactgggcgtggagccgtaaacgcactcggatttcatgaaaaatctacccgatttttctataaacgagtgctaccgccccccctaacttattattaactaaagcaggattttatcacactctcattaagttggggcgtgggtagtggtcgtttcaaaaatctcgggtagagattattagaaaatccgaccacgttataagccttcacggcgtttgagtgaaagcctttttcccatatttttgggcttcggcaaaaatatggtcgggttgttaagggtggaaaacccttaaatatgggttgttaagggagaatcccttaaagcgttacctcctcccaaccagcaggataaccactcggttcccaaacattattatcaacttttgatttataaacttttccgtttgaagcaatacaacactcatcaatcatatacataccactttgccccataggtgcaacatatggttttgctttaagaggattttttgtgtggcataagctccactgtgcccttaaattttcggggtgatctttgtaaactgtgctgtcataaggttgtaataactgccatacttgtccgttatcttttactacctgcccctttgtccagtttaaatactgatgtaattcggggttaaaatcgggaatatcatcttccctgtcaattatcgctgttccatcaagctcgggagctttttcttggaataaagttgcagagtttagtccaacttctctcattttatttaacacatattccttagactccatagctgtttaccccctctcttattgcttttgccagctcatcataagttacataatcgtttccgcttggctccggctcaggcttattttgttcctcttcccactgctttttcttttcttcgtcaagtgttaaaattccgttttcatacttataaagaaaacatggtaaatcattaaaatcttcaacacttaaatctacttctatactgttttcaacgtctccgacagttgcaaaagcaacaatatatttattttcatctaaacttattttcatttaacgtaccccccatatttctctaacgtaatattctgttccaccgccaatagattgttctgttctaataatattattatgaattggaatatctgtattaagttgagtatctgattgtttagtaaatcttcctgtatatatcgtaactgcgtttgcgttatatgttgtttttggaaccgagtcgtaacacaatacactttgtgtcgacatttggttttgttctaaaactggatatataccagcaccgaaaggatctcccgaagtagcagaacttatgttaaatactaaatatctataattattcatactttcatttaatgtaataacacctgtttttactgctccttcaaatagtaaagttcttgtaattttttttagctctgtgatattattttgaatatttaaaacttcttcttttacacttgtaatagtatcattgatatttttcccttgtgcagcacttaatgctttatctatttccgtacttgtaagattattaataatttctgtattattagctccattttcaattccatttaatttaattttatcaacagaactcataagcccgtttgtttctgttgtcacagtttcataagtcgtatcgataaacactgcatcaggtggaactgctgtttctactgttaaattatttactttatcagcattattagcattctctgcaatatcaacaacaccgtcaccatctgtatcatatacactttttagcatatcaccacttcctgcagtaacaagatgttcatcaatatagttttgtaactgaccttcaatttgtattaagttttcttcaaggtcgctttgttcaactttatcattaaacttttctacaacggttttatcaagtgtttcaagattatcaagttttgctatgtaatcatcatcaacaagacttttccctaattctttgtcaacttttaaatcaagacttgcatttacatcttcaaatctattatcaagatgttcgtctactatttcttcaagatgagtataatcaaaacttcccgtatctcctttatcgcctttttctccctttaatacgggagtatcaacaattaattcaattgccatttttttctcctttctaaatgttataagtatttttgtttacaacttcgcctatttctaaatttcctatatccgttgaataactatctcctgttttataaataaacttcacatcatattccacatcatcgccttctctaaatcttgtcatgtcttcctgagaaaaaggaacgagaaaacctcgctccttttcaaaataacttacttcacccggatattcttttattaactgttttacacctcttccaaaagaaaaaagcaccttagatataatgcttaaatctaaaatgctctcttcacttactttaaaaaataaatatccgctgtttgaatattttatctgcataattcctccttattatgcttgggattttctgaattgaaattcttctttgtttaaatccaaatttccttttcctaaataccaatcctttaaccctgaagcaatacttagttttttactaagcagagtatctaaagctttgtttcttgtattcattgtgttatatgcaagttctgcaagtttagagtttttggtgttgtaggcttgtgcaatttgattgtcaaaattcatttttgcctgttctgccgttgttcttgcctgtgatattctgttttgtgcggttgtaaagtttgcacttttactgctttcggaaaaaccgcttccgccaagaccggcgcttgcctgtttttctgcattgtatccatagggattaatgctttttaagtaatcagcatttgcagctcttgcatcacggaatgcatctttgtctgcttgtactttcttttgctgatattcttttacttgttgattagtatcattcgttatgtttgtttttgccgaattataataattatttacagcatcattagtatttttataatacttattcgcatacgaacttaaaccactatatggattgcttgccataatttacctcctttttatattaactttttactatactgcttgatgaagtttttaaatacgaactcttaactttgtatatgcttgaaggttttatatataccccttttacctttgatatattagaagagcttacttttatatatactttaggtcccccattaaaagtaagagttccgcttttagataaagaattactattaccaagaagtgtagaaccgctgtaagtttttaaataacaagtaaatgttatagtcttatcctctcctaaaatatcctctaacttagttagttcactgcttgtaaaagatacggtattcccgcttttataattagttacggtttttgaaaaagtcttacattttataactaaagtatcattaaaagctgaattatattttgtataacttgcctttattcccttatattcatttactatacttaaagagtttaactttgatattctctttattgtaggaagtgtaaagttttttgaacttattgtagctgttccaattgcaacaccactataatgtttagcacttacactaaaatctcctgcacctgatgaactatgctttatggtaaaatcagcctgtgttaataaacacggatttttataagtatcaaaattagttttagaatttgttttctttactccgtctactgttatatagcttatatgatcgtaaaagttccagtgtctgtaactgtctttacctctaagccataattcacagtgtattactgttttattagcttctttatcttgactttttacttcccattccaaagatatataaacatcatcgttgtttgaatattttcccgttacttttccgctgcttgccatatctcacctctaatacacaaatactattgagccaatgggaagattagctccataatttgaagttgtgggaactgtttttgaaaatactattttaggtgatgtattaactgcttccgatgtactttcacctacatatattttagcaatagtattatccaccctatttgttatactctccatatcggtttttatcttttctatgttcgttgtgttcgtgtcaatattttctataatttcatcatttactttaggaagcaaaaccgagtttaaatactcttttatgtctacaccggctttatcaaaagtctgtctcaattcttcacctgaaatcatcggtgtatctccaagaggctctatatttcttacatcttcatcaaatccaatcagtttatccatcaaccattcacctaccttttaatatagtttcctttgtaaccttccagtgtgaaagagaaaaagccgaaaggtctcgattcttttttgtcaattgtttcgccttttagttttatttgaagttcgttaaatttcttttgtttcgtttttattacaccatagttattatcctgatctattaaaaaacttaatgtcctaaaatccaaatctataaatgaaaaaccggcatttttatatgttgttatatacttatattctttgcttttgttggttcttatgtatattccaacactggaatttcccattactttaaactttgctattccacctcttttggaagttgtctttaaatggtttatatctgaaaaattatcggattttaataaaatatagttttccatattttcttcattatccttatacaaggtttcatcaaatacgcatatatgccctccgtctgttgcaaaataaagtttattgtcaaaagattttagatatatacccttatattcatttctttgttcatcaaatactctaagtccttcaaaataaaaccattcatactcataacctttatttacttcaaaagtctttctgctatctgcaagatacatatttccgtttataagaatacataaataccctttgtatatatccatagatgcatcaagatatttatcttcatttgtcattttaggattaacaaggctggacctttcgcatacaaagtccgaagcataaatatcgctgtttaagtcggaatatttaagcccatacattccttctttcgttaaaaaacatacatcatctttaaagtttatactgcatccaaaacttccaaaactgcttttaccctgctttacgggataagttttatagtattttgtttccgatttaccttgaatatttgttattgtaatctgctcagtgtctggcttatgataaaataaattattgccgccttcttttgagtccttaaatacccaaagaacattacccgcaaccgtaatggaagttatatcttcattatcacttccatcctgataataattaaggtcagagatgtattcagggtcgtttaattcgctgtaaaaaagaccatttttatatgttttactaccgctgaaaaatactctattatcaaaaaccgcattaattttacaattatttattctgtcagcgtacccatcaacatctttataaaacattatcactacattatcttgacctaacgtatcagccattggaggggctacgttaaaagttattgttcctttttttatgtcaattccattttctgctaatttaaacgtatcggtctttgttgttacttcgccggtctcggaattcttaacgtcatatgtaagactggttccgttttttaagtcaatataagtgtcatttatccatgctttaacataatttatgtcgttatttttaaattccgttgtatcaagaacataaacctttgttttattatctccgctaaaagaattttttctaaaacccgttagaacatttacgccttgataactttctccccctccgtccggaagtcttgaaattgaagttgtaggaatgaaaggaatatcaaaactactttcagaattttcactgtcaattttaagaacctgttcgtttatcctttctttattacctacttcaataaggttttctccgtcaaatctgtaataaattaaaccgtcatttatgtataatttttcgttatacataaaactcattgacttacattcgttcattttatccgaaagtaaaacagtgttttctaaatttatttgactaggaaattctttatataaatataaaaattttcctatatgcactaatgcaagattatccgaaagagtggtataaatatgtataccgtagattctcttgtttaactcgttatctattaaagaagaaaaatcagcgattaacttataaccttctcttgtaaccacacactgagaatcatcaagataatctttccacatattgaccatcattggagagcggttatcactaacatttcttgcctctcttgaaaaatccacgccttttatgttcttataggttctttttatggtttctgatttagccattataaacctccgccgtagatttttacgggtcttactattcccattacaccgtttttcgttatatcaagtgccgaaattatctttgctgccttttggtcaaaggctgtataatctgctccgacatctgtttttaaaacatcgcttgcaacatgataacaaagaacaataaccgaatttacatcaaggtcaagttccgtttcgtcaagtttatcatttggtatatcgcttaaatcttcacagtaaggcttatactgtgcttcaataagtccttcgtaattatttttaatatataactttttatttaagaaataataatctatatctttataatctgactttattacccttattccaagaaacttggcacaaagtgaaccaagagaataaggcttgtattcatctcttgacatttcattatcaattttaacttcgattttctttgcctttatattttcgctttgattaaataacatttgataatgaatgtttataagaggaataagtcttttgtttatatcttcatcatcggaagtatacaaatcatttgtagagtactcttcaattatcgcaagaatatatctttttatctcttttatacttcttatactcattatttacctcctttttctctaaggggctttgccccttaacaaccccacgacttttttacacgcctaaaaaagtcgaataaaagggcgccactcgccgtgggggcttataacgtggtcggattttctaaaaatctctgcccgagatttttgaaacgaccactaccgccaccctaccttattattggtcagggtaatatttaaccatattcccattaattttggtttggggttatagttaaatgggaggggtagcattccagctctaaaaatacgggtagtatttttagtaagctttggaatgcgtttaagccctcacggcgtttgagtgaaagccttttttccatatttttgggcttcggcaaaaatatggtcgggttgttaagggttgaaaacccttaagtttgggggttttaagggggggggactccccttaaggtaactctattaccccaatagaaacagttcctgttacggtaactttaacttttcctttgtttacttttacgtctttgtatttaccgctttcgattacaagagttctcatttctccgtttggaatatcaaactcaaattctgccgcttctactccttgaataccatttccactgtgtacttttacttttgcaccttctgatgaagccgaaaaaatcataagtgttttatcgtcgcatccgtcaaaatcaattaacgctccgtctgttgtgtcaattgctgttaactcaggatattctccaggagtgtttctttttatttttactctttcaatatttgttactgacatattttattctcccttcttactctgcttcgtgagcttttattgtatataattcttttggtcttactgtttttgttccataaacaagtaacccttttacagcgtccataaatctcttttcaggtctgaatggctcaacattatcaatttgttttcccgctgcaatggctctgtttgttcttatcattaagtaatcgtcttttccgtcgttgtataagttgttactcatttttacgtaagcatttttgtatttaccaagaataccttcttcgattagtttgtcgtttcttgtttttaattcaataatcttgttttcaaatacgtcgtaagcccatggagttagctcaattactactctttgtgtcataggaactccgttatctcttaaccatacaagacctttgtctactaattttttcatatcatcttctgttgatacagctgttgacgctgaaaatttacctgcattttttgcttctaaggcaatgtcatattcatatgcttcagttagccctgctgttgcttcggctctaagtgatgacattaagccctttcttgattgtgctttgtcaatatcatcaactccaaagttaaaatattttgccttgtcgatgtctagataaatacttgtatcttttacatcttcaggatcgtgaatgtcgcttccgtcataatctccgattgttggtcttgcaactccaagaatttttacctttcctgcttgtttaatgtctccgtcaaaatcatgacaacagtccttgtccagtactgccattttttccaaatctcttagtatgtttgcactccatactgtcgctttaaaattgttataactcatattttcctctctttcttttataaaaaaaagaagtaacttatgttacttccctcattttttcgatattttgataaatattttccctttccctcccattacttttctttatcctgtatttatcaaatatatcttttgataataaatttatgtttttaaatatgcttttcttaaacttaacacctcataccttcatcccacgcctaacctcgtttatagaaaagtaactttaatataataaaatttaccctcaactaaaaaccatgaaacacaaaacctgcatttcatccccacaccaaccccccctatataaatcccattcaaaatgaaactttccatttcatcaccatgtcccactccctacataaaacctattcaaagtgaaactccccatttcatcaccatgtccaacacactcacctaaaaattattcaaagtataaatttgattttattacattgtcccaccctttaacataaacatcatttaacgtaaaacttaaatttcaccatgatgtcccacacccctaacataaaacccatttaaagtgaaacgtcccatttcatcgccatgttccactccctaccataaaaccaataagcagatggggtagcggtagcatcggttcatgagaaaatcgggtatattttccatgaaatcccgatgcgttataaggctccacgcctagtggcgcccttttattcgacttttttaggcgagtaaaaaagtcgtggggtttaaggggtgaaaccccttatccactaccatctttcaatagacctattcacaatatcaagtaacttcggatttctcttaaagtcctcaaccgtaaaatcgtccacttcatcggcagtgtaataatccttaatacctccgggctttttattatctttaagacttcccgcaggagaataagtgttttgctccttattaagcacacgactttcataaacattgtagacatccattaatggaacatcatctctgaaatatttggcaaagtttataaaatcatcacttctaagtacgcttggatctttaccaatatttctaagttcattttcatttgttctaagggataactcacttgaaagcctgtttaaaagaacttccgatgttgtatccaaattatttgaatgtagaagttcatttaatacttcgttcatatcttcatctcctaaagatatgatttcatcagcataataatttccaagctttgtctggcttaaagtgtcgttgtcagaatgtgtgatctcttcatccatgaagttttccatatcagaaaactcatcagctttttgttcataatcttcttcgtaatcttcattaggctcttcatcaaaataagtatcttcctcttgttcccgctcgtcgtcataatattctttttcggtacttaagccctcatcatactcagatgaatcgtaaccatatgaatcgtcataactatcatagtaatcttcttgatttaaatcatcttgtgaaaatgattgtccttcgtaattttcttccatatcatttcctccttttcttttgtccggacttttacctttaacgtaggtaaggcgcataatttatagtcttatgaagacttgacactttaagcattcccacccaaaaccacccataaaaaaagacacttttttaagtgcctttaaagttttaagataaaatgaaattaccctcaaaacattttatttatttttccataatatataataacataacttttcaaagttttaatcccaacatattcccatatttttaaactatatttataattattttgttaggatattcttgtttaaaatttattacaaaatatttaatatttttcttaatttatattatatttttactttaatactattgtttctaacataaattacaatataataaaatttattacgtattatttaatattaagatacataatattaatcctactacattatcccaaactataaatatcaaaccataaaaagcgaaacatttcattttattaccatgttctttttcataacataaaaccaataaacataaggggtagcagtagcatcggttcatgagaaaatcgggtagattttccatgaaatcccgatgcgttacaaaccccaagcccagtggcacacttttttattcaattaaattaacttttgtaagaccaataaatagacggggtagcggtagcttttgcccagtaaaacccgagcagagttttactagacgttaaaaacattataaggaaattcacccagtggcacattttttattcaattaaattaacttttgtaaaaccaataaatagtcgggatggcggtagcttttgcccagtaaaacccgggcagagttttactagacgttaaaaacattataaggaaattcacccagtggcacacttttctattcgattaaattaacttttgtaagccaaataggcggggtagcggtagcatcggttcatgagaaaatcgggtagattttccatgaaatcccgatgcgttaaagcctccacgcatagtgacatacttttttattcaggtacattaactaaaattaagtattattaaactaataaataaatgggatggcggtagtggtcgtttcaaaaatctcgggtagagatttttagaaaatccgaccacgttataagccctcacggcgcttgagtgaaagcattttgtccagtattttttgctttggaaaaatactggtcgctctttagagcgaaaccctaaataattttgatttccccaccaaaatcaccgccgcttttaccgggcatttcggctttaaagtggaaagttctcggtttaactattttctttttaaccatttcctgttgttctcttatgtgataagtaatagcaagccccataaccaaatcatcatgagccccagctgccgcctcaggtcttcccttttcgtttcttacaaaacttaacatctcttctaaagtagccttatcaactattttttctccctcttcacgcactatctttattagatttgctattattatcggtcttgttatccttgttgttacaaaaccaaaggaacttatcattcttccggtatatgtatcttcccttttccttacataaagtttaggataatcaagcctttcaagttccttgtttggataggttgaaaagtttgtttcaattcctataagcgcatcattataatactttccaagacagtaaacctgccttgcatataaatcttcatcaaacttgttttttaaaacagcaacttgatttccggtaatattatctattacgtgtgccgtaaaattatcgctgccttctcctgccgtatctcctccaagaacataaaaagagcttttatccacatcttcgtaaatgtttataaagcccttttcatcttctataaattctatgttttttatttcctttccgtcataatcatatttaaaatatcctgtctttatgggttttatattcttctttaactgccttgttactgtggatacatcaaacacactatcacccaaaacaccccacattccaagacagtacacattgtaatagtatatatccgtatccttgtagctttcgagttcctttttgtattcatcatctataaaatgattgtctttataggtagtatgaagataggttgctcttccggtatcaataagggaagtcttaatccagtggtttatgtctatgggatttaaactcattactatctgcttctttgttttaccaccccttaaacgaacgttaagctgtttgtagtcgtcttcctctgcctcactggcttcttctatccatacatccgttaattcaccactttcaaaggttgttgattttatcttttctacatcatcaagtcctttaaatataatctggtttaaattcaccttacaggtaatggtaaaatcgcttttgtttatcaaaaataaatccctaaggttccacttgtttattatctgtttaaaaagtgcaaaggtggaagttctgtttgtatttcccgtctttcttacaacaagtatattgcaaagattgttttttagtatcttataaatatatctttggactacaaaaacgctctttccgctccccgctcctccataaaatataagtaacctgtcatcattatccaaatatggtatataaacctcgttaaatacctttttagatatttcaatactgtaacactcatcatttactttttctttaaatggaccttccatattttcaagttcactgtttctgatttcctcttttaatttttctatactgtcctttctttttttatctttcaaaataaacatctcctcctttattattaatttatataaaaaagacacccctcggtgtcttttctattcttaatctattctatccccattaattccaaagtttcttcaagatcaaccccctcaggcagcttcgtcctgtccatttcttcaacaagtccgccaagcattgcgtttaagaaatcaaggttatctttttgttctggtagtttgctaataacaacactatagtcacctctgccaatatcaacatcatcctgctttttgtatacatacattacagttttttctttattatctattattttgctaccttcatgttcaagttgctttgcaaagtatttttgtatttcttctttacttatgtttttattttgttctatatacttatttgttgccataaccgcatttttataagcttcagcataattataagaagtaacctttatttttactttaaaatatctatttttttgctctaatatacttccttgatttattaattcaaaacattcttcttcctcaataatattatattcaatgtttttatttactttttttattacatatacctcttttggatacatcaacataatcatatttttatattcaactacatcttcatcttttgaagttaaatactcatagcacttattttttaaatcatttgtaggaattttatcatacatatagaaaaaaaataataataagattaatataataaaaaaacatatattaaaaattattgtttttattttattaaaattacgttgacttttattatacataacatattcctttctttatcattatatattttattataatattatcattctttatgtataattatctcttcaagatcaaccccctcaggcagcttcgtcctgtccatttcttcaactagaccgccaagcattgcgtttactaagtccatattattcttttgattaggaagagggtaaataatataagtttttatttccatttttgaaccgccaatctcatgttccttactacatctatatacaatatttgtagtcatctggttgttttgtataattagctgtccttctttttctaactgttcataaaaatatttttgtattgcttcacggtttaaagaattatttttatttataaattcatttgtttttaaaactgcattcttatatgcgtttgcataattatagctttttacatttatactaacttttacataaaatgacatataagatatattcatagaattactatcaataacttctctatctgtaattgtatatgtaatattattcttaatgaacttttctatatcctcttcatttggatacattatctttaatatttttaaataattatcattaacattattacattcttctaaatagatactgctttttttattcaaatcttttataagataatcttcttcgcttggatttaaaataaaaaataatactatgacaacaataaaaagaagtataatttttattgctttttttaattttttattgcttttgtaactcatcaattttccctttaaatttataaattaattttaataaatattttatatatcaatttaacctactttatatctaaatataacacaatataataatattttatatattcaaattatataatataatatttattagttacacaataaaaattcttaatattcattttcacaaacaaaaaaagacacccctcggtgtcttttctattcttaatctattctatccccattatttccattgtttcttcaagatcaaccccctcaggcagcttcgtcctgtccatttcttcaacaagtcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcaagatcaaccccctcaggcagcttcgtcctgtccatttcttcaacaagtcctccaagcattgcgtttaaaaaatctaagttatctttttgccccggaagttcaactatttcatgaacaacatctccacctctgtgccctttataaataacagaatcttctttcttataaacgtacataacggttttttctttattgtctattattttccctccctcatattcaaggcgggttgcaaagtatttttcaatttcttttttacttgcgtttttattctcttctatatatttatttgttgcttttactgcatttttataggcaagagcataattatatgaagtcacttttatttttactttgtcatattctttttcaatctcttttgtacctaaatataaatcttcaatcttctttttttcttttgcttttgtcttttcaactatatcataatcgactttcttatttacatattttattccatatgttggttttggatacatcatctgcaatatacttttataatcttctccgcttccgtcctctgccgttaaatattcataacatttattacttaaatctcctggtactgaatcatcataaatatcaacaaaaaaaactaatgcaaagattaataaaagtggtgtaaatgcagctagttgtaaaaaaatactcttcttctcttttttagacataataatgttcctcaattttatcactaaatttattataattatatcacaaaatttatacacataatcataatataggtttcctttttttaatacaaaaaagacacccatcggtgtcttttttattcttattccaaatatttacaaggcttatctttaattgtgctatccaaattgtcaattatttctttatagattttttccctgtcttcatcatttgtaacaagttcataataaacattgcctttttcatccgttttttcgatataatcaaatgtcataacattatctccatcgtctctcaaaatatcagttaccatagtttcaaacttatcataagcatattctcttggtgtttttcccgttatatcttctgtcatcatatcaacaccatagttatactcatctccttccatcatacttaaaacattatagtactctatagaatacacgtaagggtgaaaatcgacaacaactttgtgttctttttcattcactatatatgaaggaagtatcaagtcatctatttcattaaaatcttcaacctccagcatatgtattattatgtctttactttcttcatgcacattttctttttttaagtcatttacatattggtttaattgcttgtcaaactgtgcatacattttatatttttctttatcataataattataagatgacttttttatctgagtaagaaggtttcctgttatattatcataaaccaaatccttttggttatcggttaacataacagtaaagtgactttctccgtttttatctacctcttctttaaatgtcaaagtcatattcatatcttcttgatattcttcatttgaccattcataatttatcttaaagtttgaataatctctgttgagctcaccttttccatattctttaagtttataataaaaatatgattgtctacattcttccaaactatatttttcttcaagtttaccatatgtatcaataccaacttcattacatgacttttcattttcaatcatatcttcataaaattcattatagtctttgctgtatatattactgttaaaatctacatacatttcacccttttcatcatcggttatttcaaattttggatgaattatttcatatatactgtcactgttaaaattctgacctttgtaattaatagtatttattatatctttgcactgaactaaatcttctctgtcactttcttttatttcgtctatgtagccgtcaaatatcttttccatatcttcctggaacttatattctctttttaatataagataatcgcatggattttctaccattgcttctcttaacccgccaaggaatgaagaatagattatgtaattattgttttcattttctaaaggaagtaaataataatttctaccaatgataaaatttattatataagagcttgctcttgtataatttcggctttcactcaaatgtacattatattcctttataaaagtttttgttacttttttgtctttgtttttttcatattcttctactaaatatttatttaatatatcatttttctcttttttgttggttactttatttttctctatttcttcatttgctttttctaaagcatttttatatattaatccatagttacactgagtaactgttagttttactctgtaatcatctgtataatttgttactttttctatttcaacatctgctttgttcattgccttttttacggaattgtctttatttaacatcctgtctattatttctctttcatagttaaactgaggataatcttcatagttttccaaatcttccgtatatgataaacaatcttttctacatcccctcaaccccaaaccgtaaaaatggaaaccattatcaatataatatgctatcgctacaataacgataagcaaaaatattatctgtttttgcttttttgtaagttttcttttttctttttccatttcttttcccctttattataatttaatttcattttatcattttttaggttttttatacaagttttctagattatttttaatataatctgtacctaaattttcaattatctcatctatatatctgttttctggaatatttattccatatttttctgcaaattcacctgctttatcaagtccgtttccaattacttttcctaaaatagcattacttcctgcttcatatatcccatttaaacctcctttccaaacagctttttattttccactatgttcgtcattatacatctgttgtttatatccatttcccaaatcattagcaatatcaatataaaatttatcaccttttaagagtgccaacgctattaagtcattttgtatatttgctgctgttatagtattttgttgcttaggtgtaccattttctgcgatatctgttattgcataatgtaaaggcgtttcttccttataacttgtatctctatgtagaagacttgaaagttgtattagaccatctatacgatcatttttatcacttagtgtagccaacccatataaagttccaagactatcacttgataaatctttaattaaatctgattctctctttaatatttttggagacaaattatccataaacttatcagcttcttcttgcccaagctctcttgcaataacaaatgtcagttttctctctttttcatccatattttcaatctttgtcaaatcttgatttttaaaagcaggatttgtgcttatagccaatgcattttcaaaatctaaattttcccctccgttcttccttacattatcctcaaggttagtacctccatacattttgatcatatcattgacttgctttattttttcatcatcagaagcagaatcaacatcatttttattatcattcatatctttattgttaaatacatcattaaaagcaacatcccaaggtgtgccgttatgagaaacttcatatttaaatcttttaagtttatcaaaaaaactttttgatttataactttgagctcttacttttttaaattgatttgcttcatcttctgtaacctttacaaaaccatcatattttttatttaatgcatttacatcatttatagacatcttacttccgtaaacagggtattcatttacataatttacacgcttatcactactactatctatatcttgtctaaacgttcctacatcatctttctttttaattgacaagttcttattatactcattcatcttttgattaaattcatctttattaaacttaccatttggaacataataatagttcataatatcacttgtgttaactggattttgcaactttgtattttttgatttcgatttagcttttaaatgctcttgtgtaaaattcctacttgttggttgtcctggtatacttatatgctcatagccatatgctttttctttatttgatttactgtccacgttctgtctaaaatcacctacattagctgtcttttgaacttttgttgtattttttgttgtcggctctactttcaaatactttttggtaaagtctttacttgttggttgtcctggtatacttatatgctcataaccatatgctttttctttatttggtttattgtccacattctgtctaaaatcacctacattagctgtcttttgaacttttgttgtattttttgttgttggctctatttttaaatactttttggtgaagtctttactagttggttgtcctggtatactgttatgctcatagacataattatccatattcttttctttgtgctctacattttttctaaaatatccaacacttgtacccctacttccgtaacctggataagcttgatataaactattattctttgtatttacagcacttctttggtcctataatatcattttttgagctttgtaaattgaatgtataaatatgcttttgattttcttttctttttgtaatcatttccctgccccctttgtttccatgaacatattgttttctttattatatacaaaaacttgagattttttttgtcgaataattgatatatttttgacaaatgattatctttcaagaataaaatcaataaaaagcttgtttttgtttttatttttcctttataataaaataattcaataaaaatatatgtaaaatttaacatgagaggttatttatgaatattcaatggtatccggggcatatggcaaaagctacaagactaataaaggaagatttaaagaatgtagatattgttgtaaaattactggattcaagagctgttataagaagtgaaaataatgattttaataaaatattaaatcagaaaaaatttataagagtatataacaaatgtgacttggctgatgaaaaggaaactatagagtggcaaaattattttaaagaaaagggtgaggatgttttctttatagattctatgagtagaaaaggaataaatgaagttttatcttacttaaataatattaaatcaacatttagagcaaatagagaagtaagagccatggtagtggggattccaaatgtgggtaagtcgatgtttattaattcaataacaaaaaaatccaacgcaaagacagggaatagacctggggtgacactttcaaaacaatggataaaggtaaaaggagaagtttatctattggatacaccgggagttcttcctccaaaatttgaaaatttggaagatggggtgtgtcttgcttctattggttctgtaaaagatacaattttggatagagaagaattatgtcttaaacttattgaatttttagttgaaagatatccagataaattaaaagaaagatacaaacttgaaagtgttgaaaaaatgcctatagaagtttatgaagatataggtaaaaaaagaggcttcttattaaaaggcggggaaattgattatttaagaactgccgttacggttttagatgaatttaaaaacggtcttattggtaaaatttcttttgacagggtttgtgatttataggagtaaaaaatgatagatgttaaaaatacaaaagtcagtgaattaagaaaaatcataaatgagataaatgttgaagaatatgaagaatatattgaattattcaaatctgatggaagaagagaagttgaaaagtttgctttaaggcttcaaaaaaaattagatcaatataataaagagttacaaagacttgaaaatattaaagagtacgaaaatagtctttatgataaaggttataagcttattgccggtatagacgaagttggtagaggccctttagctggacctgttgttactgctgccgttattcttccaaaagacagcaaaataatgtatatgaatgattcaaaagccttaagctcgcaaaagagagaagaaatagctttaaagataaaagaagaagcaataagttatgcttatggaatagttgataataatgaaatagatagaattaatattttaaatgcaactaaaaaagctatgcttgaagctgtaaataaattaagtgaaaaaccggatatgattttaatagatgctgttcatttagatactaatataaaacagaagtcttttataaaaggggatgcaaatatttattcgatatcagctgcaagcattattgcaaaagttcatagggatcatatgatggatgaatatgcaaaggaatatccggaatatggctttgaaaagaataaaggttatggaacttttgaccatgttgaagccataagaaatattggtctttgtcctattcatagaaaaacttttaccgaaaatataatagacagcagggtaaaacaaggcagaaattatgaaaaagttgttatgaattatttggttaaacatggatacagtattttaaataaaaattataaatgtaaatatggtgaaattgatataatagttagaaaagataatttaattgcttttgtagaagtaaaaggacgtcataaaaatattatagcacctaaaagttatgtggatgaagaaaaaagaaaaagaataatagacagtgcaaaacaatatttaaaagaaaagagtttaaatgataagtttaaaattcgttttgatgtagtagaaataactgataaatcaagaggaacttttgatgttaaagttatagaagatgcatttagagaaaataaatagtatattattgtctgaaaacttaatacttttcaaaatatttagaatattattgaaaagtatttttttttagtgtaatatggtaatagtatataatttaggaggacatttttatggaatcgattttgctcgatagaataagaaagttaaatgagatattaaaacttacagccgttgaagtagtatcttttgaagagttaacaaatgagttgagtaaaattttgaaggtaaatgtatacatatccgaaaatgacggaacaattcttgcttattcaacaagtgacaggtttaaatgtgacttgacttactatcctaatgaagaagctcattttcctcaaaattttacagagaaattactttcttatacagacacagtagaaaatatatatgaagaaagtcctatttgtacttttggaagccaaggaccttgtgtttataaagatagatatatgactatagtaccaataaacggtttaggagaaagaatcggaacgttattattcagcaaatatggcggaaagtttgatgatgatgagattatattatgtgaatattctgctgccatagttgttatggaacttttaagatatattcaagatcaaaggaagaaaagcagtgctgatatagcggctgcgaaaatggccctttcaactttatcatactctgaagttgaagccgtaaaaatgatttttaaagaagttgaaaacgaaggactcgttgttgcaagcaaaattgccacagaagctcaaattacaagatctgttgtttcaaatgcacttagaaagcttgaaagtgcaggtatcatagaaacaagatctcttggtatgaaaggaacgtttataaaaatagttaatcaagaattaagagctcaattaaatcaataagacactccttcgagtgtcttattttatacaaataatgatgttatttttactataacccatgctatgaattctccacctccgcttaatgccgatactgactgtgaacctgtttctaccaaaccacttgcttgtccgacagaagtaaataaaggagctaagtctgtagctatatatagcattcctataatgacaattatgcctataaccaaagatctaaaagaatttcttcttgccgccaatacagcaggtgccataaaatatgtaagagaaggtaaatcagtaaaaggaagcaatttgtttcccggtaaaattaccgccaatattagcgttatcggaaccattaccattgcaattgtgattatttctttgtctcctaaaagtattgccatatccatacctatattaacttttctgcctgggaattttttgctcatgaatgactgtgcagcatttgaaagagggcttagtccttccattaaaatttttaccattctaggtaataagaacattacagctcccatgcctactcctgacattaaagcagcttcccatccttgaccggaaatcagagtcaatataaatccgagtataaaacctaagaatatcggttcgcctaggaaagaaattttagggtttagtttagtcaaactgaaatggactttatttattcctggtattttttctattaatttatcaatacccatgcatatatataacactacggggaaagattgagttgttatggttacaccaggatatcccaaaaaatcttttatcctttctgcatgtttgtctgcgagtaaaagtactattcctccatataagcctccggcaatacatcccattacgaaattacctgtaagagcatatactaaagctcctcccataataaaatgccagaaattccaaaggtcaacatttaatgtatctgttaatttaaaaatcatcattaatatatttattgcaattaaaattacgaaaagagcaacaactaaacttccgttgctgaatgctatgcctgaagatacaggccatcccatatcatatgtatcaagtgctaaatgccaatttttttgtaagccttcaattataggtgttaaatacgttcccattgtccccgtaaccaaatttatacctataaatcctacaccaaccgtaagcccggctcttaaagctttaattggtttcatttttactataattcctattataaatattattataggcatcattacagatgcgcctaaatctaatattgtttgaattatttccatgttttttctcctttttattttctttgttttaaagtttctgcaattttttcataaagttgttctgtgtttaggttcattaaaatcggtactgcatcaaaagtcggaatttcttttgtttctacactgtcaatcggagttgtatgaatgattatatccggaggattgttttgtataagtccgccggcttccgaaacgttggcttcctgtatgtttacgtcatttattccgagctcttcaagaccgtcttttaaacgctgcgctactagtgttgatgttgcgattccgctgccgcagatagatagaatattgtacatttctttactcctttcttataaatatttttttatggctgcaagaatttcatcttttgttgctgccgttgaaagcatattcattgattctttgtcctgtgttatagaaattacgtttgaaagcaaaggtaattgctttttcccgtccgtaaaaacaagtccgaaaacgtactttacctgtacggtttcttttggattagccatttctttaaaagggacggattcttttaattgaaaaacgattatacacggttttattacatgcttgggatctgtatgtggtattgcaattgaccacggttttataggaagacctgtaggactcaattcttctctttctaaaagggcttctacataacttttttttacatatccttttttataaagtatattacctatttgagttaaaatatcttggtaattttttccttttacattaagataaatatttttttcgtcaatcattttttgttcctttcttaaatgaatttttgtgtactacatataaattctttatacgtttttgaatttataagaatatcaatattgtttttatcttttgttaaattatttataaatttgaaaaagtttcgtataaatgttttttcatctttttttatagctaaaacaaatatcatttttactttaaaatctccccatataatcgattgcggggtagttataactccaatttttgtttcgttggaacatgctcttatgggatgggggattgctataattccgtctatcacggtattggatagtttttctctttcgataagtttgtttaaaaaatcattttgtacatatcccttaagatacattgcatttgaaattaaagataaagcgtcatttttagtttttatatttaaatttgggaagaacaaatctttttcaaatttgtttaaaatattgctgttgtcgtttgaattttgagattttaaataaattttttcatttgccgtttcttcaattaattccgcaagtttttgttgttcttcatttgataaaaccaagcctatttgcatatactttatattttttttgtcaattaactctttttcgaccttacatgttgataaaatcaaatcagattcttcctgtaaggcttcttgtattttataaacgggataatgtcctataatttctatgtttgatgaaaatatattttttagatttgatattaataaatttgtataacttgtttttaaatgcgatattattattgtttttactccgctttcaccgtaatgaagtttcattctttcgattgcagccgctatatgagcggctatataacttaattcactttcatttaatgttatgtttaaaacttttttaaatatttcatatatgtgtaaagagagttcgaatatgaatgtatattgtttttttattatttccaatataggactttccgctaattgctgatattttactctgttaattaaagcttgaatatgaaaagcaagtcccgtaaacaattcatcatcggtacttaaatccaaattatagtcattttttatgtttagtattaaagattccactatttctattatttgttttgagcattctttttttgtttcacctgtacttttttccgtcggattaagtaaattgacaaatgataattttattgctatctgacatatttcattttgtttgtattcgtttgtttcgatttcttttcctatagttttttcataaatgtcatttgatgcttcataaagtttgtcgttttcctgtttttgcttatcatttattgaaattatttttttgtttaaattaaggcgtatctgtgcaataatgatgtatactgatatatctgctattgcgctgtcatctaaatttaaagaatactttattgcaatggattctattattttttttgtttcttcaaaatcgttgtttgtgaaaaaatcgtttgtaataaataagttttgtttttttgcatcgtattttagcattattatttcatttaaaagaaatctcagagttgtttcatttccgataagttctattctgcttttttttcttctgatatcgattgaaggataaatgctttttatcatttttttcatgttttgaatttctgtttcaagagttgttctgcttatatacaatttttcttcaagttcaaataaatcgacactgttttttgagcataaaagtattgtaattatttcataaactctttcatctttttgttttttatatccttcatattgtgaaaggatgttatttaataattctttatttttagattcaagtttatatccttttcctcgtttggaaataatctgacaattatattgttctaaaatgtaatttaaaatgcctatatcatttcttacggttctgtcggaaattcccaagaatgtcgataactttgttcccgatacatattcttctgttattaaaaggtatttaagcatttttctttgtcttggcgaacagtagaaaagattcattagaaatacctcctttctcttatctttaatttgaaaagttttgttaatttcttttgttgtaaattcattatacagaatgctcctttttattatcaaacttataatttccgtttacttgcggaagaaaatagattttttattattttatttttaaattgggaaaaacctttgtttaaatttatatttttaatttattaatgtgcattaataaaaattatataaagatattgtgaaatatttttgttaattgccgtatgtatacggaaatatttggtttgtattttacttttatgttgttttatactttctgcagatttaataatacggaggtgaatttttatgaaagcagcagtacttaataaagctgaagatttgaaaattattgatttggaaatgccaaaagcaagagacggtgaaattattatgaaagtaaaaagtgccttaacttgcggtacggatgttaaaacattcagaagagggcatcctacaattccttttggaggaaataaagtggcgtttgggcatgaaggaagcgggattgtatatgaagtaggaagtggggtgtcaaattttaaggtaggagatagaatagctgcacataacacagctccttgtcattcttgttattcatgcagggtaggagattatagtatgtgtgatgatttaaaacaaatacgaggaacatgggcggaatatgtaagaatacctgccgaaattgttaaagaaaatgtttttaaaattccagatgatatgtcacataagcaggcagcactgttagaacctctttcatgtgctgtttatggtgttgatttatcagatattaaactcggagatacagtagtagtaaacggatgtggtccgataggtttaatgatgttaaaatgtgcgaagttgaaaggagctacagttatagcctgtgattttacggatttaagacttgaaaccgctaaaaaactcggagccgatatgattgtagatttgaaaaaagttgatgatcaagtcgaagcggtaagagacctcactccttattcaagaggcgttgatgttgcaatagaagcaaccggagttcccgaagtatgggagaaaaatatgttaatggcaagaaaaggcggtatggttatggagtttggcggatgcaaacctggtacaaccataacagtagatactaaattacttcattattctcagcttacaattaagggggtttatcatactacacctaaacatgtaggaatggcttttgaacttattaaaagaggagaatttcctgaagatttaatgataaacaaaagctttaaactagataatgctttggaggcattattgtcccacgcaaacggagaagtcataaagaatgaaattaaaatagattaggagtttttaaatatgattaaatataaagaaataagagaacaagttttaaatgcagcattgaggtctaatgagcttggtttgattcacggtacatccggaaatatttccgttcgtgataaggaagataatgttgtggcaattacaccgagtaatatcgcatatgaaacaatgaaagttgaagacattgcgattgtggatataaatggcaagtggatagacggaaattttaaaccttcaagtgaaacgcctatgcatactgcagttttaagacgtagagatgatataaatgcagtagttcatacacattcaaaatatgcaactgttatgtctatgagatgcaagcaacttcctagagcaactgttccttcaaatatgtattatccaatagtttgcactaccgaattttttcctcctggaagtgaaaggttggcccaaacagcagttgacgcaataggtatggataatgatgttactctcttaaaaaatcacggacttttggcaactggatgtgatattgattcggcaatgacttgtgcaatttatactgaagaatgtgcagaaatttcatatttggcatctattgtcggatttgatgattttatcagtgaagaagatgctttgtatataagaaatattgcaaaaggaggaaatgctgtatagcatttatatactatgaataattttgaatattatgcccctacaaaagtcgttttcggtaaaaatgaatttgaaaatttaggaaaagaagttgccatatatggtaaaaaagctttgcttgtggagcaaaacggacctttggatgatatgggtgtatttaaaaaagcaattaaaataatgaaagattctaatattgcagtatttgaattaaagggtattgaaagcaatccaaaactttctaagatagaagagggaataaaaattgcaaaggacaagcaaatagacgttattgttgcagtaggaggcggaagtacgattgataccgcaaaagccataggttttggggtaaaaagtgatggtgatatatgggattattttagtttgaaaaagaccataatcgatactcttcctgtgattgcggtttctacaatttctgcaacgggagcagaaacctctatgcattgtgtggttacaaacgatagagattcagacaataaaaattggttaaaatgggctttgcatgatgtgcatttgtttcccaaaacagccatcatagatcctattctgttatcttcggttcccaaaagattgactgctgcaggtatggcagatacaatatctcatattattgaagggtattttgacggtgctccgaacaatcctatatcagacaggataggagaaggtattgtatgtacggttttggaaaatgacaatgttttggataacttgtcagatttagatgcaagagcaaatattgcttgggcatctactttggcaatgagtggacttcaggattgcggtcgctataatgagggatttccggctcattggattcaacatgccgtcggagcaatgactgattcttcgcacggtgaggggcttgctgttattaatccttcatggttgtttatgcaaaatgagaaaaatcctgaaaagtttgttcaatttacaaaaagagtttttaacattgaacagggaacaatttcagatgaagagtatggtaaaaaaggtattgagcttttaaaagagcgttttgtttcctggggattaccttcgaatttatcggaacttggagtaaaagaagaaatgattgatgaaattgtggataaagttatgaccagcaaagaaacatatgaatttaatcgaaatgaagtaaaaaaagttttattaaattgtttatattaatttaatataatattctcctttaaaattttaagacgcccaaaggcgtctttttgattcgttcaaaataaaaacatgtattatattatgttttaaattaaatatattttgcaataatagtatttatagctttgttgacttttaaatacatatatattagtattagttaataaagaaaaagaggttttaaatgtataatttaggaaaaaacgaatgtaagaaaattatattgttaataacttatgcaatactgttttattattttgtaacaaattttagcagtgtgttaggtgtgttaagtacaactttaggaattttatcgccttttataataggttttgctttagcatttatactaaataaaccttttgtgttttttagggataaagttcttgggaaactagcagataaaaataagaaaaaagaaagactggggcttagagccggaattgcaatattattggtatatttattggttatcatatttttagtattaatattttcttttgttcttccacagtttgtaaaaagtatttcagggcttataaattatatccctcagtattcaaaagagttatttaatacaattgataatatggtagataaagtaataataaatgaaacgatgctaaagactattgagaaaacaagtacttcgattgcttcaactatgaaaactgttctttctaatgcggtacctgcaattgtttcttttatttcaaattttgcatctaacgttataaatattgttattgctgttatagtatctatatatttattatttgataaagatcatttgaaatatcaatatagagttattgtaagagcctttttaagtgaaaaaaatgcaaatagagtattacgcattacagaacttacatctaaaactttttccgattttataggaggacaaattatagatgcaattataataggagttttatgctcaataggtcttgcgatattaaatattccttatgcattgttaattggtactatagttgggtttaccaatataattccatattttggaccttggataggttcgattccaagtgtgtttattttgtttatggtaaaacctatgtatgcgattatatttataatatttgttgttatattgcagcaagttgatgcaaatattatatatcctaatgttgtaggaagttctgttggtctcggagcgttatttgtaactttttcaattattgtaggtggaggtttgtttgggcttgttggaatgattttaggggttcctacatttgctgtaatatatacattggttaaagaaaaggcgtataaaaatttaaagaaaaagaatattacaaaagtatagtaaaccttgacaaatacaggctaaaagatataaaataatattttagaaaagataaaggagatgcacgatatgtttacaatgataaatccccctataaatgaacttttagataaagtagataataaatatgttcttgcaatgcttgttgcaaaaagagcaagagaactttatgaaggagacgaacaacttgtcgacgaacattttgtaaatcttattacaacagcagttgaagaagtatatgaagataagattggatactatttaattgaagaaggagatagaaaatatagagtacacaagagtgttgatttaaatgaaatgttaaacaattctttataattaatacaggactaacttatgatagcaaatgttttgattgataccttaggtgtggtaggagataaaatatacgattataaaataccagataatttaataaaagatattgaaataggcaagagggttcttgtctattttggtagaggtaagaatttaattcctgctttggttataggtataaatgaaaatagtgaatatgaagaaaacaaaataaaagacatagtagaagttttggatgaagaagtaattgttcatcagtatttaattgatttgattaaatatatgagggacaattatttttgtacctatattgatgcattaagatgtgttcttccgtctttggaacaagttaaaagaaaagaaacttattccttaattgaaaatgataaacaaatagatgaaaaatatgggttaattatagagctaataaaaaagagaaactcccttgcaagtttcgattatttaaagtcaaaacttaatttatccaaaagtgaattaaaagaagaaatatcatatttggttaaaaaggatattatttcaaaacaagtatcatattatattcaagaagaaaagagacaagaagttgtttctttaagcggaaaatatgaaaatattgaagattatttgaaaaaaataagagcaaacgccataaagcaaattagtgtaataaaagctcttgaaaaaggagagctttattatgagaagttaactaagcttacaggtgcaaacagaagcattataacaaaattatctgaaatggaattagttaggacttattttatagataaagatgatgaatttgatttaagtctaaaagaagaacataaagatgttattttaaatgaagaacaacaaggagtattagattcatattttaatgaaaaaaatacaaataaatttcttcttcatggagttactggaagcggtaagactgaagtatatataaaaatgtttaaagatcagataaataaagggaaacagtgtttatttcttgttcctgaaattgctcttactcctcaaatgatgagaaatatatattatagatttaatggtgaagttgcaattatgcattcaaaactttccatgtcaaaaagaattaaagagtgggacagggtacgaagcgggaaagcaaaaattgttttaggggcaagaagtgcgttgtttatgccttttaaagatcttggacttatggttatcgatgaagaacatgaaaatacttataagtcatctcacactccaagatacgatacaatagatcttgcaaattttatttctgataaaacaggtgcaaaacttgttcttggaagtgctactccaagcatagaaagttactataaggcttttagaggagaatatagacttcttgagatgaagaaaagagctaacggaaaagattttcctaaagttcatattgtagatatgactgatgaaatgagaaacggaaatagatctccaatcagccgtttgttgaaaaaagaaatagaattaagattgaaaaaaggagaacaaagtattctttttatgaatagacgtggattttctacatatgtattttgtagaaaatgcggatacatagaacagtgtccaaactgtgatgtgtcacttacctatcatgcaaatacaaattctttaaaatgtcattattgtggatatgaaaaaagttctccaaatatttgccctgaatgtggaagtgataaaataaaaagagcggggacaggaacgcagaaaatagagtctcatgtaagaactatgttcccggatgtaaaaattttaagaatggattttgatacaaccagaaaagcaggaagcatggaaaaaatactttctgattttagaaataataaggcagatatattgataggaacgcaaatggttgttaaaggtcatgattttgcaaatgtgactttggttggtatacttcttgcagatactgcacttaatttccctgatataaattcacctcaaaggacatttcagctttgcactcaagcctcaggaagagcaggaagagcaagtaaagagggaagcgtagtaatgcagacttattctcctaagaataaaacattggtatattcttcaatgcacgattataaaaaattctatgcatatgatattgattatagaaaaaagatgaattaccctcctttttctgaaattctgggaatatttattgcaaatgagtcggaagcaaaaagtaatgaagatataaatttcgtatataataaaataaaagaacttttaaaagaaaaacaaagagaagacgtaaagctttatcagcctatggaagcttttatacataaattaaaaaataaatatattatgcatatacttttaaggtataatgtagatgatgaaataaaaaaagatattagaaaaatttttagtgaagtaaataaggaaatatcttcaacaatatttgctgagataaatcctgttgctttgttataggaggaatatatggcacttagaacaataagaacaaaagaagatgaaattttaagaaagaaaagtaaagaagtaaaaaaaattactccaagaactcttgaacttatagatgatatgcttgaaacaatgtatgatgcagaaggtgttggtcttgctgccgttcaagtgggagttcttagaagagttgtagttatagatattggagaaggtcctgttgtacttataaatcctgaaattatagataaaagcgaaaaagaataccttgaaattgaaggatgtctaagtgttccgggagaacaaggttttgtatttagaccagaagaagttaccgttaaagctttagatagagatggaaaagaacaaattattgaaagcaaagaaagatttttctctaaagcaatttgtcatgaacttgagcatttagatggaatattatatacagatcatcttgttgaaccaagtgaagaacaaatgaaagaaattataagacaaagaaaaattgagcaagaggacgaagaataatgagagtagtatatatgggaactccagaggttgctgttaaacctttggaaaaacttattgaaagtaatcatgaagttttacttacagttacacagcctgataagaaaaattcaagaagaggaaacaaggttatattttctcctgttaaacaatgtgctattgataacaatatagaagtatttcaacctcaaagagtaagtgatgaagaaaattatgaatatataaaatcatttaatcctgatgttattgttgtttgtgcttatggacaaattgtaaagaaaaatatacttacactagcaaaatatggagcaataaatattcatgcatcattgcttcctcatttgagaggagctgctcctctccatagagcaattatgcaaggggataaagtaacaggtgttacaattatgcaaatggatgaaggtcttgatacaggagatatgcttttaaaaggtgaaatagaaattgataataaaatgaatgtaggaattttacatgataaagttgctttgctcggaagtgaacttatagttgaagctttagataaaatagaaaaaggcgaaattaatcctgaaaaacaagatgacagtaaatctagttatgcaaataaaattttaaaagaagattgtcacataaattttgataataatgtagaagatatatataatatgataagaggattgaatcctttccctctttcatatgtaaacttagatgagaaaaacattaaaatatatgaaagtatcattaaaaaagaggaaataaacgaaaaatgtggtacaattctttcatatagtaaaaaagataaagcgattttggttgctgccaaagatggtattgtcggtataaaagagcttaaaatgcaaggtaaaaagaaaatggacgcggcaagcttttataacggcaacagggatatcataggcaaaatttttgaataaaataaaaaggagataaatatatgttttttagttattattatggaggatattttataattttaattcctgctattattctttcactttatgcaagtataaaagtaaattcaacttttagcaagtattcaaaagttcgtaatagcagtgggcttacaggatatgactgtgcaagaagaatccttgatatgaatggtttaagttatattccaattgaaagagtttcaggaaatttaactgaccattatgatcctggtaagaaggttttaagactgtctgaaagtgtttatgatgtggctacaatatcggcaataagtgttgctgctcacgaatgtggtcatgcaattcaacatcaacaagagtatgcgcctttaagcatgagaaatgctatattccctgttgttaatatagcttcatatgcttcatgggtatttattttacttggaatagtgcttagttcattctcattccttgttccattgggtatagttttatttgcagcaactgttgtattccaactaattacattaccggttgaatttgatgcaagtaacagagctgtaaaaatattatctcaaaccggaatggtatttggtggagaagctaaggctgcaaaaaaagttttaagtgctgctgctcttacttatgttgctgctgctttatctgcagttttacaacttcttagattagttttaatttttggtgacaacagataaaaataaaataaaggaaataaatttatggcgaagaacattaaaatctcaccttcaagagtgagtgcgtataaagtattaaatgaagtatttttaaccggtgcatttagcaatatttctctaacaaaacatttaagagcaataaatattgaagctgacagaagactttgcacaaatatagttcatggtgtaataaaaaaatttaataaacttgaatatattttgtcaaagttttcaaaaatgcccgtaaatgaacttgatgaaagagttaagataagtatttatataggtttatatcaaatagtataccttgataaaattccagaatatgcccttgtaaatgatagtgttaatttagttaaaatgttcgtaggtaaaaaagcttccggctttgtaaacgggattttaagaaatgctttaagaaaaaaatatgaattaaaagaaataacttttagtgattattatgatataatgaattatgaatatggatttaaaagagctttggttgagaagctcttattgtcatatagtaaagaagaacttctttcgtatgcaaaattttctatgttacctccaagtctatctcttagagtaaataatttaaaaacaacaagagatgaacttattgaaagatttaatataaaaggttttgaaacaagaaaaacttttgttcctgaaggggttgaaattacatcttctcttaatgttacgttaacagaagagtatagaaaaggacttttttctattcaagatagtgcaggaatgcttgtttcatatgcattagatgcaaaagaaggtatgagtgttcttgatatgtgttctgctcctggcggtaaaagtatgcatacagcagaaaaaatgaacaataaaggaagtattatatcttgtgacatatataaaaagaaacttgaaataatggattttagagcaaaacagcttggtatagatataataaaagtaagaaaacaagacggaacaaatttctgtgaagagtatgttgatagctttgatagaataatttgtgacgtgccttgttctgggcttggagtaattagaagaaagccggaaattctaaaatattattcaaatgaaaaaatagatgaattaaaaaatatacaatattcaattttatcaaatgcggtaaaatatttaaaaaaagacggaattttggtttattcgacttgtactataaataaagaagaaaatgaagatatattaaacaaagttttatctgaaaatgaaaacttggttttagattccataaatctgccttttgaatttgaatatgataaagaaatggcaaaaaaaggaatattaaacgtacaaggagataaaaataatacagatagtttctttatttcaaaaataaaaagaatttaatggggatatgatgaagaatttatttggactaacgttagaagatttggaaaaaatagtcatagatgaatttaaggaacctaaatttagagcaaagcaaatttttaaatggctttattcttcttatgtgaaaaatatcgatgaaatgacaaatttatccttaagtttaagagataagttaaaaagtaaatattatatttctcatttacaacttgaaaagaaatttgttgaaaagggaagtaatacaacaaaatttttattaaaaaccgaagatgatattttaattgaaagtgtacttttaacttatgaggcaggctcgactctttgtgtttctactcaggcaggttgcaggatgggatgtgttttttgtgagtcaggtaaatgcggattacttaggaatcttacaaaaggtgagattttaaatgaaatttatcttgtaaacgagattgaagatataaaggtatcaaatattgttttgatgggaagcggagaacctctcgataattatgatgaggttattggttttttaaaacttgtaatggataaagatacactaaatatgtcaaaaagaagtattactttatctacttgtggtttaaaagataagatttatcttttggcagatagcggattagatattaatcttgctttatctcttcatgctccttttcatgaaatgagagaaagtatgatgcctgtggaaaaagcaaataatatcgatgatgttttacaggcaactttttattatagatttaaaaccggaagaagaataacatatgaatattgcttaatagagggaaaaaatgatacaatagagtgtatcaatagactttatgaattatttaaagatactgatggacttataaatgtaataggggtaaatgataattccaaagaaacggtaaatgacaaatatattcatatatttgtaaataaacttagaaaaaagggaataaacgttacgcttagaagaagactaggaagcagtataaatgctgcttgtggacagcttagaagcagatatttaaataaagaggtataaagatgaaattagttggaaccagtgatgttggtatgcttagagaaattaatcaagacagttttttaatgcttgaaaataaagaaaaagaaattattgcatttggcgttgctgatggtcttggaggacataatgccggagaacttgcaagtgctctttgtatggatattttaagagagtattttaatatttctaataaattttatgaagaaatgaaaaaggaagtaaaaggcattattgaatatgcaaataaaagaatcttggattttgctaatgaaaacaaagaagcagcaggtatggggactactcttactttgtgtatatatcatgagggagaatgttttatagttcatattggcgattcaagatgctataaaataaataaagatgaaataaaacaaattacggttgatcattctttggtttcacatatggttgcaagcggagaaattacaaaagaagaagcagagcatcatccaaacaggaacataattacaaatgctcttggtacacaagaagagttctttattgatacttatgttgaaaagttaaaaaaaggtgatattattcttatttgttccgatggtctaagcgaacatgttgaaaatgaagaaataaaagaaatagtaaatagtaatgatttggatacagcaaaacatttacttgtggataaagcaaatgaaaacggcggaagtgacaatataactgtagtattgtttgacggaggattagaataatgatgataggaagagttttaaacgacagatatgaaatagttcaatttgtcggacaagggggaatggctaaggtttacttaggttttgataaagttttaaacagagatgtagccataaaggttcttcaagaggagtttacggataatgaacaattccttaataaatttaaaagagaagcccaagctgcaggaaaattatctcatcctcatatcgtaaatatttacgatacgggtattgataacaatatttattatattgttatggaatatgttgatggcggaactttaaaagattatattaacgcaaaaggaaaacttagctatagagaaagtatcaattatgcattggctattgcatctgcacttagtcaggcacataaaaataacattattcacagagatgtaaaacctcaaaatatattactaaccagagcaaaaagacttccaaaagttgctgattttggtatagcacgtgccataacatcatcaacaatgacaatggtagatgaaacaatgggaagtgttcattatctttctcctgaacaggcaaggggaggatatcttgatgcaagatcagatttgtattctcttggaattttattatatgaaatggtaacaggtaaattgcctttcgattctgattctcctgttgctgttgctttaatgcaaatacaagaagatatagtacctcttagagatatagatcccgaagctccaaaaggtcttgaagttattattcaaaatcttactgccaaatctccaaatgacagatatcaagatgctgcaagtttaatagaagatttgaaaaaagtaagaagtgattttaatgctcatataaacagaataggaatggatgatacatcacctacagagagaattcctattatcagagatgaagaaatagagcaagttcctaaaagggttcctcttgaaaatactgatgactatgataaattaagagaagatgaagtagaaaaagataaaaaagataagaaaaagaaaaaggataaagaaggaaaagcaaattggtttaaaaaacttcctttaaaaatgaaaattcttacaggagttttagctgttatgcttattgctggtatagtatttgcaggaacaagaatttttgcaaaggaaattacagttccgagtgttgtaaatatgacacaggctgaagctattgcaactcttgaaaaggcagggttaaaagtagatactccaaagatgcaaagttctacggaagttgaagcaggtatggttatttctcagtctcctaccgcaaatactgtaataaaatcttatcaaaaagttactattgtagtttcaagtggaccaaaagatgttgaaattcctaatgttgtaggtatgcagcaagaagaagccgaagctgccattacggcccttgaacttgaagtcaaagttgtaagtaaatataatgatgatgttgaaaaaggtgaagtttataaacaagaaccagctgcaaaagaaagcataaagcaaggcgaaaccgttactatttatgttagtaaaggtgtaagtaaagttacaatggaagatttaagtggtttatctttaagtgaagctaaaagtaaaatcacatctcttggtttagttgttggggatatagaatatgatacaagtgaaaaatatggaaaagatgtagtaatcagttcttcaccaagtcaatatgaagaagtaacaaaaggttcaagtgttgatcttgttgtaagtaaaggtttaattcaaactaaaacaatggcaatagatatcggtgaattctgtaatagtacaggtaaaaaagttaaggttgatattgtttatgtagatccagatggaaatacatcaacagcttacagcggaacagtaaaagatactgatattataagggtaacttttaaaggatatggagttggatattttaaagtatatattaacggaagcgaaaaaggtaatggaggaatagttactttctaatatgctaaaaggaaaaattttaaaaggagtaggcagtttttatactgtctactcttataacgataataaggaatatacacttaaagccagaggggtatttagaaaacaaaaaataactccggttgttggagatgaagttttattttctgccatgaataccgaggacggaagcattgaaaaaatagaaaaaagaagaaacgaacttattagaccaagtatttcaaatgtagataatattgttattgtgtgtgcattaaagcagcctgacataagtttttttttattggataaaatgcttattaatgcttataacgaaaatgttgaaatatatatttgttttaataaatgtgatctttgtacaaaagaagaaatagaagaaataaaaaatatatataaaaattcaggttttaatttaatatttacaagtaatattacaaaggaaggcatagaggaaattaaaccgatacttaaaaataaaactactgtttttatgggagtatcgggagcaggtaaatcttctatgattaattccttatatgataattataaacttgaaacatcacatgtcagcaggaaaataaaaagagggagacatacaacaagacatagtgaacttttcatggaaaatgaaaatacatttgttgcggatactcccggattttcatctcttgaagtttttgatgtaaaaaaggaagatttatatcattattataatgagtttattgaatatatagattgtaaatttcctaattgtgttcatataaacgaacctgtgtgtggcgttaaggatgcagttaaagatggaaaaatcaatattacaagatataatacatataaacaaatttttgaagaaattaaatcaaaggaaaataaatattaatgaaatttttaatggtcagcggcggagaagtcagcgattataattttttgaaaaatgaaatagataagtttgcacctgattatatagttgcaatagataaaggtgcaaatcatcttagtaaaataggaataaaagcagatgtcttaataggggatctcgacagcatagatattaatttaaaagaaaaatataaagataaaattttaaaactacctgttgaaaaagatgataccgatacggctgttgctcttgattatgctatggataatggagcaaaagaaattaaaatatatgcatcggttggttctagatttgatcatacatatgctaatgtcttattattaaaaagagcccttgataaaaatataaaatgtactttaataaacgaacaaaataagattagtttacataataaaagttttagtataaaagaaatggttggaagtacagcatcattttttgcatttgacaaacctgttactttaactttaaatggattttattatcctttagataaatatcttatgaaaaaatatgatcctttaggagtaagcaataaagtaacaagtaataatgcagaagttatatttgaagaaggagagcttcttagtattattgcaagggataaataagggaaaaaataaaaaaatatataaaaatgtttaaaaaatatacaaataggtttgcatttagttaaaatctttgttataatactatgtactgtgaataagtaagaaattatgttttagatataggaggaatatattatgcctaaagaatgttatgtatgcggtaaaaagattacaagcggtaaccaagtaagtcactcaaacattcatacaaaaagaacttggaaacctaacttaaaaaaagtaagaatcgtagaagataatacaacaaaaaatgtacaagtttgtacaagatgtttacgttcaggtaaagtagaaagagcgtaagtttaatttaatatacgataaataaagatagtttttaactatctttttttattaccttcctatattatgaaaattatctttgaacatatggaaaaaacaataaattacacctgcaattattaatgcataccaaatccatttagggaaaactaaaataagtaaaataaatatgatacaggcaagaagacaatcgataattaatctgtcgttgtggcaattcatttttactcctcctttgtttatactatatagtattaaaggatttaaaaatatgtgaataattaaataaaaaaagccctggtgtaagggcttatattttaatagctattttctatttcttttattttgtcatatagatagtcgttaagaggtgtttctatattatgttttttacctaatttttttatagttccagcaaaaagctcgacttctgtttttctttttgcttttgtatcttgacgaagggatggtgcattgtctgggcttaatgtatccattaaagccatccaatcatttatttctatatctgtaagttctattccttccgcttttgcgaccttttgaacttctttcataacatttataaccatttctcttggtttgccttgtttttgaattcctccgtatgttgtttcatatactgcaactacttggtttacagcatcgtttaacataagtttgctccaaaggttatgtaaaatgttatcaggtatttcgtatggaagatttgaatttataaacagttcctctactttttttacatcttctgttattatattgtctttgtttccatagcatattgttccaacttttgaaaaagaaacattgttattttctttttgagcatccattccgtgtacttcgcagtataaaagatgtttttctccgtaatgttcttttataatattttcactttctattccattcattacagataagaaaatggtatcatctttaacaaaatttttaacggattttatagcttcatccattccggtaaatttaactgcgaatattataagatccgctttttgctcattttctttatcacatacaaagttaaaattatatttttctccattaataatataatccatattcttatatttttttaccctgtcttcatcagcgataaaatatacttcatctttaagataatcttgtaaatatgatgcatacattaaccctaaagcacctgcacctattataaatacattttttatttgcatataattcactccttatcttttatattttatcataaaagatggatttgtctaagatatattaaaactttacaaggtataaaaacacaggtataattaaattaatttaaagtgacggagaaaatatgaaaaaaagaaattttaaaaagaatttaccatacattatacccatatgtattttagtattatttgttgtatttaagctttttacaatggatatttcctttggagaaataaaatgtaatttaagtgataatccgaatattgtaagtttattaaaggaagcaaaaagcaaagaaaaaacgcttcaaataaatggagcaataggggatacttcttactgttatgaatatgaaagcagtgatattacaggatatgaaaacagtgacttaaatttaaaaagttttgatgaatacaataataatttaaaagaaactttgggatgtgaaaatattgtatcatttgaatacagtgaaaatataaaattaaacggaactcctaagttagtattttataatttaaaagaaggcaattattctttatttgaaataagagaaggtaatatttattatttgagcgatacagttacaaataaaaatgaagtatcttttgatgtatccaatacttcttacgtttatgttttggcaagtggagtagatgatgatactatttcaaaattaaaaaatgataaacttgaaataaaaacttcttcagatgaagaaaagacaaaacttattgctgcaacagaaaaaaaaggcgaagaagaaaataatcaaaataagaaagaatattactttaatttaactattgaatgtaaggaagcagtagaaaatattgatttaataaaagaagaaaaaagaaagtatattccatcaaacggatatatatttggacctaaaaaggttgttttttatgaaggagaaaatctctatgaagttcttttcagagagttaaaaaaagcaggaattccttttgatgcgagtgggtatagtgagtattctacggcatatgtaaagggaataaataatctatatgaatttgaccttggggcatcttcaggttgggtttattatgtaaatggaaagcagcctaattatggttgttctgattatattctaaaaagtggtgatgaggtcgtttggaaatatattaaaggaaggtaaaatatgaataacagggggatgtttgtaagttatagctcatatgtaaatattctatattttataggtgtaatggttataaatatgttttttatgcaccctgttattttatttatttcttttgtttcttcattaacctatagcctttatttaaacggaatgaaaagcttaaaatttgatttgtttgttttatttcctcttttattatttatcattcttgtaaatcctttggttaatcatcaaggcactacgatacttttttatataaataatcaaatgataacaaaagaatcaattttatatggaatatttgccggaatgatgataataaatatgtttttgtatttttcatcttttaacaaaattatgacaggggataaaataatgtctgtcttaaagtttgtttcaagaaagttatctttaatttttgtaatgactttaagatttgttccaagatacaaaaacgaatttaataaaattaaggtgtctcaacagtgtttaaatgaagggcttaatgatggtaatttctttgacagaataagacatggttcaaatatgatgtcttctcttgttacttttgcccttgaggatggaattgatactgcagatacgatgattgcaaggggatatggactaaaaaataaaagtaattataaaagggaaaaatttacaagtgatgataaagtattttttacattgatgataatactttttttgattgtaacaattggaattattagaggacagttttatattaactttttccctgattttatttttacggaattatctatacataatgctttatattttgtaagttattttatttttgcaatggttcctatgataattgaaataaaggaggctttggtttggaatttatcaaaatagataatcttagtttttcttatccacataaaaagaatgttttaaaaaatatctcttttaacattgataagggggattttgttttgctgtttggtaaatcaggaagcggaaagtctactttattaaaacatttaagcataagccttgctccttacggagagaaaaaaggaaaaatatattataagggaattgaaagtgagaatatttctttaaaggaaagatgtgaaaaaatagggtatgtaatgcagaatattgatgcacaaattgtaaccgataaagtatggcatgaactggcttttacacttgaaaacttaggatatgataatgcaaaaatgcacagcagaatggcagagataacaagtttcttttctatgtcatcttggcttgataaagatacttcgtctctttccggaggagaaaaacaaaaattaaatttagctgttagtatgcttacttttccagatgttcttcttttagatgaacctacttctcaacttgaccctgtaatgagagatgagtttataaggcttttgaagagaataaatgaagactacggtacgacaattattataacggaacactcctttgaaggtattattgaaaatgtggataaatgtgtacttattgataatggaagattcgtatttaactcagataagctatccttaactgatgaaataatagaaaataaaaagcaatattatgaatttcttccagctgttacaaaatttggacatgagattttaaataaaaataatattttaacggtaaatgaagcaaagaagaatttaataaaatcaaatattaatttaaaagaaaagattggaaaaataaaacatagaagcaaagaaagcataattgaagttaaaaacgtttcttttaaatatagtaaacttgaaagaaatattttaaaagatgtatctttaaaaatatataaaggggattttttatctattataggtccaaatggtgttggtaaaagtacatttttaaatttgcttattggttctttgaagccaaataaagggaaaattattaaaaatggaaaaatagcgatgcttccgcaaaatcccgtaagtctttttattaaatcaaaagtaaaagatgatttatatgatattgatgaaaattatatggagcttgtagatgagtttgatgtttcttcattaatcgaatctcatccttatgatttatccggaggagagattgaactaatggctcttattaaggtgcttttggttaatccggatataatcattttagatgaaccaacaaagggaatggatgtaatatataaacaaaagcttggtgggtttcttaataagcttaatgaaaaaggtattacgatagttataataagccatgatttagagtttattggaaaatatattccgtactgctctattatgtttgatatggatattatgccttttaaagaaaccagagaggtttttggggaaagttatttttatactaccgatataaatagaattacaaaggataatttaaaaaatataataaatttacatgaggtttttatagatgaaaacaaaacagtataaatcttttataatttcctttgttgtactttttatattggttcctataattatttttatatctcaaagtaacaattcaaattaccttttaccaagttttatgataatttttgtttcctttttaccttttgtgtatatttttgaaaataaaaagataagagtgagggaaattgtattaatatcaagcatgtctgcaattgcagtacttgggagaattgtatttttctttgttcctcaaataaaagtcacttcagcaattataattgtttcagcggctactcttgggagtgaagcaggattttttattggcgttgtttctgcctttgtttcaaatttcttttttggacaaggaagttatacaatatggcagatgtttgcttttggtatggttggttttttaagcggaataatttttaagtctgaaaggataaaaaacaatagaattttagtttgtataataggttttattttaacatttttagtttatggaggtgttgtgaattttcattcacttgttttatatacttctaaaattaactttgaaagttttaaggcggtatacctattatcacttccttttgactttattcatgctttatcaacaagtgtgtttttatggtttatacaaagacctttttttgaaaaaattgatagaataaaagaaaaatatggtatcatatatcatagatagaataaagttttttgtttatataacttattaaatgttaagggaagcaggttggaatcctgcacagtctgtgctgctgtattagtgtagtaaatatcaatatgccacttaaagggaaggcggtatttacgttgaaacttaagtcagaagacctatttaataagacctataaactctacacaggaaatagagtatggtaaaaaattatatggtattttttactgctctaagcctgaaaaaaggcttatttttatttaaaattagaggaggaaaaatatgaaacaattaagaaaaagaattatttttgcactactttctttattgatggttctatcttttagtatgcctgcttttgcatctaatgcacaagaaactttaacaacttcacaaaaagcattaaatgccataaattctgcagcaacttttagactttcaactcttgaaaatccatcaacaggaaacaataacgaaggagattggtttatctttgcacttcaaagaggtgatgtagaaatggcaaacaaagaagaatatacaaataagtatatttctaatgtaaaaagcaatatttcatctcttcaatatccgtcagattacgcaagagtgataataactcttacatctcttggtgttgattgcagcaaagaatttgaaggggtaaatttacttgaaaaaatgcttgcagataaagcaagttttgaaggtacatttgcttcaaatgcaatatatgctcttattgccctaaattgtaatgactatgatattccaagcacatgcgatattacacaagatgatttggtatctgctttactttcttataaagatgaaaaaacaaatcttttctattttagtacagataaaacatatggaacggatttagatacaacatttatggcaaatcaagctttaagtttatgtaatgtaagtgatgataatttaaaaacacaaattcaaaatgcaaaaacagcttgtattgaaacaataaaatcttcacaaagcgcaagcggagcaattagttcttatggaatggataatgcttgtacaacagctcaagcaattgttgcattaacacaaatgggagaagatgttaacagttatcaaaaagacggtaaaacattagtagacggccttctttctatgcaagatagcaatacaaatggttttataggatatacaggtaaggcggatattcaaacgactgatcaaagtttatatgcgttagttgcttattcaagaagtgaacaaggcttaaatactttatttgatatgaacagtacagatacattatctttcgatcctgattcattctctgctaaagtagataaattctttgataatataaaaggatttttccaaagattattttaatatttaaataagaaaacagaagttttaaggcttctgtttttctttgaaaattttacaaaaaaataattgaaaaaattttaatatagataaaataatacttgtatatataaaaaaattgtattataatatgtgaaagttttgaaatttcagacattttaaagctaaaggtgttaaaacataaaatatctaataataattaaatattttatgtcttaatttgccttaatatataaaatatttaatttggaggaacaaaatggattatattaataaagttttagaacaagtaaaagctaaaaatccaaacgaaccggaatttaatcaagctgttatggaggtacttgaaagtttaagacctgttattgaagctcatcctgaatatgaagatatgggtattcttgaaagaatgacagaacctgaaagagcaattatgtttaaggttccatgggttgatgataatggtaaagtacaagtaaatagaggttttagagtacaatttaatggtgctatcggaccttacaaaggtggtttaagattccatccaagtgttaacttaagtgtaattaaattcttaggttttgaacaagtattcaaaaactcacttacaacacttcctataggtggtggtaaaggtggttctgattttgatcctcaaggaaaatcagatgctgaaattatgagattttgtcaaagtttcatgagtgaattatatcgtcatatcggaccagatgttgacgttcctgcaggggatattggtgtaggcggaagagaaatcggatacttatacggacaatacagaagaatcagaggcgcttttgaaaacggagtgcttacaggtaaaggaattccttatggcggaagtttaatcagacctgaagcaacaggttatggtgcaatgtactatgctgaagaagtattaaaagttttaaatgattcttttgaaggaaaaactttaatcgtaagtggttatggtaacgttgcttggggtgtatgtaaaaaagctaaagaattaggagcaaaagttgtttctatttcaggtagagatggatatgtatatgataaagacggaatcaatacagatgaaaaaattgatttcttacttcaaatcagagaacgtaacgatgttaaattaaaagattatgctgaaaaatttggtgctgaattccatgcaaaagaaaaaccatggggacttaaaggtgatatagctatcccatgtgcaactcaaaatgaaatcggtattgaagaagctaaacaattaaaagcaaacggagtaaaacttgttgttgaaggtgcaaacatgccaactactccagaagcaatggaatattttaaagaaaatgacgtaattttaggacctgcaaaagcagcaaatgccggtggtgttgcagtatcagctttagaaatggctcaaaactcaatgagatattcatggagtgcagaagaagtagatgcaaaattaaaatctattatgcaaagcattcatgaaaacagtaaaaatgcaagtgaaaaatatggacttggctatgatttagtagcaggtgcaaacattgcaggatttgaaaaagttgtagaagctatgattgctcaaggtatctattaattaaattatttaattataaatgatatatcatctatttaaactttaaaggacctttaaaggtcctttttaattttgtataaaaataaattttatgtaattttaaattaaattttttataaaattaatattaaattttaaagatataaaaatatgtaagagaatatttattgacaaaaaaatttttaaagaatataatgaaataattaagaaaacgaaaaggtggtgaagaaaatggatgcaggaagtagtattggcattgaatccggggggcgtatgaaatcggtattaaatgtactgctttttttgtgcgttcattttctaccaacattataagctctcgtttgatgttttgtatccaatttttacaaaatgaacaaaggagaattaattttagcgtatttagaaaatcgtgattttagaagtataaaaaatacgataaaagacatgaattttgcggatattgctcttctttttgatgaaatatctttagaggatataccgcttatttttcgtgttttaccaaaagatacggcaagtgatgtttttgttgaacttgataatgaaaaaaaagaatatttaataagaagttttacggatgaagaattaaaagaagttttagatttaatgtttgttgacgatactgtagatattatagaagaaatgccggcaaatgttgcaaaaagaattttaaaacatactaaatccgatacaagaaaattagttaatgagattttaaaatatcctgaagatagtgccggaagcattatgacaactgagtttgtttctcttagaaaagatatggatgtttatgaagcttttttaaagattaaggcgaccggtgttgataaggagactatatatacttgttatgtaacagataatacaaaaaagcttataggtattgtttccactaaagatttacttctatccgacatggaagaaaaaatagaagatataatggaaacaaatataatatatgtaaataccgtggatgatagagaagaagttgtaaaagtattcgataaatatgactttttggcagttccggtagttgataatgaaagaagacttataggtattgtaacagttgatgatgctattgatgtaatcgtacaggaagatacagaagactttcaaaaaatggctgctatggctccaaatgaagatacttattttaaaacttctgtctttacacatgcaaaaaagagatttggatggctattatttttgatgctatctgcaacttttactcaaactataataacccattatgaagccgcttttgcaactatacctcttcttgctgcgtttattcctatgataagtgatacaggcggaaattgtggttctcaaagcgctacaatgataataagaggtatgtctttagatgaaataagaccaagagatattttaaaagtaatattaaaggaaagtgaaatatctttaatggtcggtattgtcttaagtgttgtaaatggaataagaataattattacatatcatagttttgttttggcattggttcttggactaactttaatgtgtactgtatttatgtcgaaacttttaggcggtattctgccaatgatagcaaaacaggttcatttagaccctgctgttatggcatctccgcttattacaaccatagttgatgcatgttctttgataatatattttaatatagcaatgcatatactaaaaatttaaaggagagttatatggaagagaaaatattagaattacttaaacaaagaaatttttttgagttaaaaaaattattggaaacattgaatccagccgatatagcttctctttttgatgaaatatccacagaagatgtattgcttgtttttagattattaccaaaagaaacagctgcggatacttttgttgaattggataatgataatcaagaatatcttataaaagcatttagtgacgaagaacttaaagaagtattagacttattatttgtggacgatactgcggatttggttgaagaaatgcctgcaaacgtagcaaagagagtacttaaacatacagatattgctacaagaaaaatgattaatgagatacttaaatatcctgaagatagtgccggaagcattatgacaactgagtttgtgtctttaaaaaaagatatgactgttttagatgctttaaataaaataaaagcaacaggggtagataaggaaacgatatatacctgttatgtaacagataatacaaaaaaactaattggtttggtttccacaaaagatattttattatccgatatggataaatatattgaagatataatggaaacgaacataatctatactcatactcttgcagaccaagaagatgtagttaaaatgtttgataagtatgacttacttgcaattcctgttgttgataaagaagacaggcttatcggtattatcacggttgatgatgctatcgacgtaatcagagaagaaaataccgaagactttgaaaaaatggcagctatgatgccaagtgaagaaagttattttaagacttctgcatttaaacatgcaaaaaacaggataatgtggcttttatttttgatgttatcagcaacaatgactcaagctgttataactcactatgaggctgcttttgcaactgttcctttacttgtagcttttattccaatgattacaggaacaggaggaaactgcggttctcaaagttctacaatgataatccgtgggcttgctttggatgaaatagaacctaaagatatatttaaagctatgttaaaagaaggagaaataggtcttttggtaggtgttgctcttgctgtagtaaacggaataagaataatgattttttatcatgattccgtattggctttagtgcttggaataacacttgttgcaaccattattatggcaaaattaatggggtgtgttcttcctatatgtgcaaagaaattaaaacttgaccctgctattatggcttcaccattaattacgactcttgttgacacttgttctattttaatttattttaacgttgcacttcaaattatgaatttataaaataaccggataatccggttatttttttaatgcttttttatacatatattttaattcttttgtgatattatcttttttcccataatatttttctctttcttttaaagctatataaatgcttaagctttcgtaatatttttcgttgatctttaacacttggtgcatagatgttattttttcattaaaatgacaatgatggttttttctttgtaaatcataataatttcttatatggtttgtaatgttatatttaaagtgtttaaaaatgtttgtattatatttgtctagattttttttatttgttatttcccttattccattgtttagataattaaaaaaaaattctttttctattgatttattacaaagaagttgtgcgtttatctttatttcttttatgttcattttctgtctcctttaagataaatataccatgttttaaagaagaaaaattaacgactaattgtaagttttttattattaaattaagattaaattaaagtatatttgttaaaaataaaaaaataatgtgataaaatataaaataaaacttttatggagtgtagacatgaaatttgatataaataaagaatatgctcttgctttaagcggaggtggagtaaggggtgcataccaaataggagtatggcgtgctttaattgaagaaggaataaaaataaaagccgtttgcggaaccagtattggtgctataaacggagcattgattgcacaagatgattttgatatggctttgaaactttggagtgaacttactcctgatattgtttataacaaagaaagtaatgtaatagacagaatcagggatatttcaaagcttgaaactcttttaaaagataatcttgatgaagagaaaattagaaacagtgatattgattttggacttgtaacttttaatttaacaacaaaagaaccggttataatttttaaagatgaaataccagaaggtaaaatggcggattatattttggcaagtgcaaattatcctgttttttatcgtaaagaaattgatgaagaaatttacgttgacggaggaatatatgataatcttcctagaaaacctcttgcggataaaggatataaagatattatagaagttgatattaatcctcctttaagtgatataacaaagaaaaatgtatgtgatgatgtaaatatttataatattaccagtaagcatagtcttcacggacaatttatatttaaccaaaaacaattaaatgataatttaagtaaaggctatcttgatgtaaaactatataacgatgagtttttatcttcacatttttatgttaaaaaaccaacaaataattatgacatatctttgaaaccaaaggatatagcaaggcttattttagatgatagatttatcggtatatttttaaataataaaatagttagaaactgcataatatacattaatgattattataagtcaaagaatggttatgacgatggagatttatccattagagatgaaaggttctttatggctgcaatggaaataacagcagaggttttagatgttgaaccaataatgctttattcatatgaagagtttagagtctgtgttgtaagagaaatatataaattgatttctaaagaagaagtaataactgatttaattaaaaatggaccttttaattctaaaaatgatttaaaagattattttgataagaaaactatcttggcattacttatctttttaagctataaaaatcaaactttggaaaaaatcatatataaaatttcacctaaaatattgatatcatttattacatcttttattgttatgaacagactaaattttgatttagttatagaagattagtcaattatcaacaaataaacactgcataattaagggaaaaacgtgaattttactaaaagttatccacatacaaacaagttatccacagttttccacaataaaacatataattttaaaagaaaatgttttaataagaattttattacattttaaaaattatgtgaaatatttgtgtaatatgactatatatttgtcattttgtttaaagaaataaaaaaaacttcaaatttttgttaaattgtattataattattaagatattttgtttaaggagtaagtaacgtgggggatgtaaaaacaaattttataaccaatgaaatagataaagatatagaaaacggagtttatgcaaaagacgaaatttatacacgttttccgcctgagcctaacggatttttgcatattggtcatgcaaaagcaatatgtataaatttcctaacagcaaagaaatacaacggtaagacaaatcttcgttttgatgatacaaatcctgcaaaggaagatactttatatgttaatgcaataaaggaagatataagctggcttggttttgagtgggcaaaagaacttcatgcatctaattattttgataagatgtatgattacgccgttgaacttattaaaaaagggcttgcttatgttgatgatcaaagttatgaagaaatgaaaaagaacaggggaaatttaaatactcccggagttgattcaccatatagaaacagaagtatagacgaaaacttaaagctttttgaggaaatgaaagaaggaaaatatgaaacaggttcaaaagttttaagagcaaaaatagatatggcaagtccaaatatgaacatgagggatcctgctttatatagagttgttcatgaagagcatcataatactaaaggtaagtggtgcgtttatcctatgtatgactttgcccatcctattgaagatgcaattgaaggaataacacattctttatgttctcttgaatttgaagaccatagaccgctatatgactgggtacttgataatcttgatgattacaaagaaaaaagaccaagacagattgaatttgcaagacttaatttaacaaatcaagttatgagtaaaagatatcttagacagcttgttgatgaaggatatgttgatggatgggatgatccaagaatgcctacgatttcaggttttagaagaagaggggtaacacctgaagctatagttaatttctgtgaggaaattggtgtcagcaagtctaactcaactgtagacagcggaatgttagaacattttataagagatgatttaaaacttaaagctgacagagtaaatgctgttttaaatcctttaaaacttacaattacaaattatcctgaaggcgaaattgaaatgcttgaaatggaaaataatcaagatatagaaaatggagaaaaaagagaagttccttttggcagagagctttatattgaaagagaagactttatggaaaatcctcctaaaaaatattttagattattcccaggtaatgaagtaagacttagaggagcatattttgtaaaatgcaatgaagttgttaaagacgaaaatggagaagttgttgaaataaaatgtacttatgaccctgaaacaaaatcaggaagtggatttacaggaaggaaagtaaaaggtacgattcactgggtagaaagaagcacagcgattaaagcaaaagcaaggttacttgaacctttattcaatacagaagtttcaagtgataatttcctcgatatggtaaataaagattcgctaaacgaaaaagaaatttatgttgaaccattccttaaaaatgcaaaagcaggggatagattccaattcgtgagaaatggatattttagtgtagatcctaaattatctaaagatgaattagtgtttaacagaatagtatctctaaaatcaagctggagaccacctaaaaaataaaaagagcctttaggctctttttttatgctgcaccgcttccgaaaagtacctgctccatttttcttattgctgcggtttttattcttgaagtatattctcttgtaagttgtatttctcttgatatttgaagcatatttttattatttataaaaaactcggttataatttttctttcaagatttgttaagcagtccattgctttattaattttttctactttgtcttcaatttctttttcttctctaagttctaaaattttattatagataatatattcttttaaaagatgttctgtctttttataatttttgctcttcatttttttactccttaattttcaattcttctttattttcagttttttctttgtttaatatgaattatattcatattttaatatgtataacaatgaatgtcaatatttttatgaataatattcaatattaatcaaaaatatctttacaatatgaatgaaattcaatataatataaatatattttaaatattaataacaaaaatgacaataaacggagaaataaaaatgtttggtgaaaaacttagagcgttaaggaaaaaaaataatatgactcaggttgatttggcaaaggcacttgaccttgataaatcttccattgcaaagtatgagagtgcggggataataccttcagttgacactttacaaaaaattgcttctttgtttaaagtttccatagattatctattaaatgcacagctatatgatataaacaatatagtgaatgttgagataataggaactgttgttgcaggaagagacggtatagcaacttatgaatttcttggtgtttctcaggctataaacataaatgacaaagaagaatataaatatcttaaggtaagaggggagagtatgtctcctcaaattatggaaggagatttggctcttgtaaggcttcaatctgatgtggacagtggagaccttgctgttgtaataatcgacggtgaagaaggcgtaataaaaaaagtgcaaaagacggaaaactctatttctcttatttcttttaatccaatgtatgaaacaagagtctttgtaggaaaagatatggaaaaaattatgatatttggtaaagtcgttaaagttgaaagatgttattaacatgtggttaataaaaatttgatttggttaaatttcattcaatagtatttctttaatattttatgtaaaatattattaagaaaatgttttagaggtattaattaaatgaaaataggaaatattatcaaagaaaaaagaattgaaaaaggacttactcaggaaaaagttgcaaagtatttaaatgttagtgctcctgccgtaaacaaatgggagaaaggatacacttaccctgatataacccttataccacctcttgccagacttttaggtacagatgcaaatactctgctttcttttaaggacgatttaagtaaaaatgaaatagcttttatcttaaatgacataacatcaaaaatggagaatgagtcttttgttgatgcttataatactgcaatggaaagaataaaagaatatccaaacagtgaggaattgatattttattctgcgttggttttatcaggtggtatagagctttattatacttcaaataaggattattataaagaagagcttgataatctttttaaaagggtaatagatggggataatgacgaaataagagaacaagcattaaaaatagtttgctcaaaatatatacaaaataatgagtttaataaagctgaagaaattattttgaagttagatgataaaagttttgataataaaatgttaaaaaattctttttatcttaaaaaaggagagtttgataaatctttaaaactgcttcaagaagaactgtttataaaaattaccgaaatacaaaatttattactttatatgataaataatatgcttgaaacaaataatgttgaagatagtgaatatatagctgggaagatggaagaagttgcagatgtttttagtatgtgggaatataataaatacataggcaaatggcagatttttgtgcatgaacaaaatgtagataaaactattgagtttatggaaaagcttatatccgctatgaaatttgaattaaaacatgacagtattttattttcaaaaattaactataaaaataatatggatatatccaaacaattattaagaggtcttattcaagaagttaaaacctctgaagaattaagttatctaaataaaagcgaaaagttttggaattttatagaaaagtattataatgatataaagaaataaaaggagataaatatcatgaaagacgaaagaccttgcagtaaccaatataaggacgaatgcccttgtacatacccttgtgataaccacggaagatgttgcgattgtgttgctcatcacagagaatgcggaggaattgtagcttgtttgaaacaaaataaataacacactttggggtgtgttatttttttactcaatttgttcaggtactaaaatcaaatgcaaacattggtaactcgtttagtgttttacaataactcaatttgttcaggtactaaaatatctgttcatatttgtatcaaatgtgcattgttttacaataactcaatttgttcaggtactaaaatgatatgtataacaaggaggagtaataatgtgttttacaataactcaatttgttcaggtactaaaataccgttcctgttgcctcaatccttaattttgttttacaataactcaatttgttcaggtactaaaatttatttggcattattaatttagctacttcagttttacaataactcaatttgttcaggtactaaaataaattgtgcatttgagaattatgatgatgagttttacaataactcaatttgttcaggtactaaaattttatcaggaatgtccgaagcaaaacttttgttttacaataactcaatttgttcaggtactaaaataaactgttgagcaagcaatagacggaacttgttttacaataactcaatttgttcaggtactaaaatgataaatgatttgcatttataatgtatttagttttacaataactcaatttgttcaggtactaaaatttgttctaatgaattatctatattattttggttttacaataactcaatttgttcaggtactaaaatacttgatgagaattattttaatatagcagagttttacaataactcaatttgttcaggtactaaaataaatatcgggaataagttaggtttagaattgttttacaataactcaatttgttcaggtactaaaatacatagtaaaaaaaatgtgcaaggaaaataagttttacaataactcaatttgttcaggtactaaaatcgttgaagcgtatttagttctaggtatggcgttttacaataactcaatttgttcaggtactaaaataatcaaatattgggtctctttcttctttttgttttacaataactcaatttgttcaggtactaaaatatataattttcaatttacttttcatcttttgttttacaataactcaatttgttcaggtactaaaatttaaccgaggataaagatgaacaatatattgttttacaataactcaatttgttcaggtactaaaattaggctcacaagaaaaagcggttgaaaggggttttacaataactcaatttgttcaggtactaaaatattactcaacctcgttatttttctcatattgttttacaataactcaatttgttcaggtactaaaatgggaaactttgtatttttattaaatctttagttttacaataactcaatttgttcaggtactaaaataataatagataaagacggaactattataggttttacaataactcaatttgttcaggtactaaaattagcttcctctgttaaacaaacctacatttgttttacaataactcaatttgttcaggtactaaaatagtgctaataaatttttaattatagcttcagttttacaataactcaatttgttcaggtactaaaatctacaattccggtaaacgagtttttggaaagttttacaataactcaatttgttcaggtactaaaataggcataatcaccttattgaaaataaaaaagttttacaataactcaatttgttcaggtactaaaattaaaggagaacaataatgaagatatcttatgttttacaataactcaatttgttcaggtactaaaatgtcaaattgcagaatttataaaaattttcataaatttataaattctcatattcataaaagcaccctccttttacaataactcatatatattataccataatttatgataaaaggaaattgttttctagggtatttaatgtttctaaatgctttgaatgaataaacagattatcattaaatatttttaatataacatcactttttatattataaatttcttcttttcctattttatttattatcaattttaagattgttattaaatataatcttttatattatttaaaccaattttaaatgaatttgaaaacaaattatttaaaagacggttatcatctttcgctgaaattgcataactacttaaaggaattatatttaaaaatgaaaaaataatgcctaatataaaaataaaaaggaacattttaggtatcattgatgcaagaacattgtataacatgttatcagatacatatggataagcatacattaatgaataaatatcccctgctagaaatagcatagcaaaaataacatataatataacacaagctaatacaaaaataagctctattaatgcaggaattaaacattctttaaaccttgtaaaatataagaaaagatttgtaatgttaaattcttttccatcatccaattcaaaaataagcctaaataaacctattgtaaatgctgcagaaacatataaatttataatagaaattacaatacttaaaataaaagactcgtctgcaatgaacccacctatgacagaaaatgctaattgaaccaaataaacaaggaaaaatgaacctataatataccagaattttcctttaagtaattccttggctctatctctaattactgcacgattaataaaattatccatatatatcccctttaataaataatattatttaaaaaataaaacccaaactgctagagctgcaacaaccaatccctcaacaataaccaaagctttttttgcgttcataataatcctccaaaacaaaaataatttgatataattataacataaaactatctaattacaagttatatactgctttcaaaatccttagcatttactatcttttcgtacttaatcatctgtccatattttacaaaagctccgggttgagatttatataaatctaaaagacccatcttttcttcaacctgttgttgagttaatggagaaagataattgtcaaccttaaaaagttctcccttatcataatattttgtaaaataaaacaatgtatctttatttatatatttattatataatccggtagtaatattattaacgtatatatgatgaatatgtccatattcaccttcaggattatgcgttacaaccttattccaatttttatataacaaaacagtttcaatatcctttgttatataatccattactccggcttctttccaatcaactctcctaaatttatatgcgtcaggataagaaagtactatacatttatcatttgtttttttcattacatcatttagttcattatatctgatattccctgtttctttaccatttgtaatgcataataccaaataatcttcattaataagttccattgctgaccacaaagcttcatcgtcaggatgagctattatcattaaattttccacatttgataaatccattttatccaaatcatctttttttaaaaaaggtgattttatatgtgcatcataattattatgtaaaaccaatttttcataatcaagtccggcaaataaagatttaacggagtatcgtattgtcggattatattttatattaccgccaagcaaaagaacaaaaacaaacatcatgaaaatataaaatagaattaaaaataatattcttctctttttttccctctccatattaacaatctccaaatggtacgcctgagaggagtcgaacccccactaagcgggccgaagccgcctgctctatccattaagctacaggcgcacgataatataatttataattctatcatttatgactttcttcatcaatattatacacaattattaataaaaatttaacatttaaaaaaatatatattttttataaatttattgtataaatatattgaaaaaatacaaataaaacattaaaatgctatttagaaatataaagttttataaaaaaatttgttattaattctaatgcatgacaaatgtaacagtatcgaacttttttaaaaaaaacataattttattgtttaaattatttatatttatgttataatagtgttgtgcaaaagtaacgtgaaaggataattatgattactatacttgttatatgcggaagtggtgtcgcaacatcaactttagcagcagaaaagcttaaatcaatttgcaaagaagaaaatattgatattgaaacttatcaatgcaaagtcagcgatgccaaagcaagagcaaaaatgattgatccagatataatcgttacaaccgctgaattaaaccaagaatttaatatacctgtcataaacggaaaatcattaattacagaaaatgggatctcagaatttaaaaaagaattgttttccgttattgtcaagctgttaagttcaaattcaaattaagtacaaaacggaataaccgtttgtaataaaagttgctttaaataaatctttttaaaagtacatattttggtaaataataggattttattatttatttaattaatggaggattttattatatgaaaactattttagttgcatgtggaacaggtattgctacatctacagtagctgcaaaaaaatgtgaaggaatttgtaaagaagctggtattcaagtaaaaacagttcaatgtaaagctgctgaaactgcttcaaaagtaaaagttattaaaccagacgtaatcgttggtacaacagatattcctggagatatcggtgatacagttcttttaaatggtagatgcctacttacaggtgttggtttaaatcaattcaaagaagatttaattaacgctgttaaataattaatttaattacattttatttttaagtatttattgttaaaagatttatcttaaagaacgaaacacaattctattagaccgaatgaaatagtactttacataaagaacagatttttatctgttctttttttgtttaaagagaattaccatttgtaattttttacaaaagataattatgtttattgacacttttatttataatgtgatatcatataataaagataacattgttttaatagaatttaaaacaaaaataaatgcaaataaaaaaggagaattaaaatgttaacaaacaaagtcgcaattgtaacaggtgcaggaacaggcataggtaaggaagttgcgaagctgttcggaaaaaaccatgcatctgttgtgataaattacagatcaagcgaaaaagaagccaatgaagtaaaaaaagaaattgaacaaatgggttcaaaagcaataacagtaaaaggtgatatatccaattatgatgattgcaaaaaaatcataaaagaagctcttgatgcttttggacatattgacattttagttaataactcaggaatgggactttcaaaaggtaatatccttgatataacggatgaagaatatcataaagtaataaaaacaaacatagatggaacatattatatgacaacacttactttaaaacaaatggaagaacaaggaacaggaggaagcattgtaagcatatcatcttctgcggttgcacaaccaagcagcggaaacggtccatatgcaatgagtaaagctgcggtagaacttttaatgcgctcaatcgcacaaaatcatggagtaaacggtataagatgtaatatagttgctccaggacctacagaaacaaacatggtaaaagaattctttgatgaagaaaagagaaacagagtaacgaaagaaattcctttaagacgttttggagacccaaaagaaacagctcaagctgtattatttttcgcaagtgatatgtcaagttatgtaacaggtcaaaaaatccacgtcgatggagggagaactataagataaatttacaaaattaaggagaacaataaaatggaagaaaaacttttaggaaaagttgctttaattacaggagctgcaagaggcataggaagagaatatgctcttagacttgccaaacttggagcagatgttgttattacagatttagatgtaaaagcaacaaaatttaaagaaaaagatgttcttgctccaaccgtaaaagaagaaattgaagttttgggaagaaaatcaatggcatttgaaggagatgcaaccgatgataaatttggcaaaatggttgtagatgaagtaataaaagaatttggacatattgatattttaattaataatgttggaggaacaggaggagcaggacctgctcttgctactgagatggatacagataaatttgttcatgctctaaatattaatttactttcaacttttattttctgtaaatatgttgggaaacaaatgaaaaaacaacaaagcggtaaaataattaatatttcttccgttggtggttcagtacctttatttattactcaagctcattattctgcaggcaaagcaggtgtggactctttaacacgtacttttgcattagaacttgctccatatggagtaaacgtaaatgcagttgcaccgggatatatacatacagtaaaatgggatgctcattttgaagagcaatttagtgaacttacagaaaaagttcctatgggaagacttggtaatacagaagactgtgcaaaagttatcgaatttttggcaactgatttatcagattacctaacaggtcaaacaatatatattgacggtggattaaaaactttaaacccttcctcttcaaaacttaacttgtactaatttgtataagaacacttgcaatcatttgtaatataaattataatattgtaagtaataagaaaaggagaatgaacatgaaaattattatcgcagcaagcatgaaagatgctaaatttgctaaatttgaagatttaattcacactaactgtggaaaagatgttgaagttgtaaaatgtaacgttattacagataatattgaagaattaatagcttcagaaactcctgatgctatcgttaaagttggtgtaaaagttcctgatacagatattcctgtaattgatggattagcacttaactatcctcaaatgggtgctaaaaaactttatgatgcaatcaacaaattaaaataataaaaaaagagaagataatcttctctttttttattctactctgaaaaatttttctgcaggctgtttacaaataggacaaagtgccggcggattctttccttcatgaatataaccacatacactgcatttccatttcacgatttcatttttttcatatgaactttcttcattaaaattaattgtatttaataaatcttttataatatcctgaggaatcgtctcatcgcctatcaaagattctaagaaagcttttgaatttccactttgaggaatcataaatcccgcttctctgcttagatcctctgcaacaagtcttgacgatttttcggcagcaaccattaatgcactgttacaacttcttgcaatgttttccaattctattttatttgaaataatagctcttaatgcttttattgtatcatcttttttcttttgttgtacaggtaatttttttggaaccattgaaatagccgctgaaggacatacttcactgcatgtgccacaccctatacatttctctacatcaataatactattttctgtatctgttgctcctgtaggacaaacatataaacacaagcaatcttttgtacataatcttaaattacgaactgcatatttttctgacattttacattctcccttcaactttttcaaacttccaatccggaaccttacatacaggacaaagtgccggtgcgtcttcccccaaatatataaatccacatacactgcaaatccatacatttgttttttcaatcatgctttcaccttcttctttatatcttctaagcaaggaatccaacattcttgtaactttttctccccataccataacacgttgtgcacctctatcagaattttttcttgctatttgatttgcatatggataaagcacatctaaatctttttgtaaaatatcaagcatatcatctatattacagtctttaacaccttcacccttttgtaaaaacacttctgataattttctaaatccatctgcctgtttttccatgtattgtttttcacatccctttgccaaatttgagcataaaatgctcatttccatagcagacatttcttttgaaacatgaggttcatactcaatttcattatttatttcttctactactggtttaaaatctgttttacttgcaccacaaagaggacatttccaattagaaggaaattcttcccattttgttccagccttaattcctttatccggaatccctttttcttcatcataaacataaccacatatcttacaaatatactgcattttatttacccctttttttataatataacattatatataattattttctgtgacttagtcacaaaaaaaacggtgctttttttgcaccgttttttaataattaggaacaccatatcccattatattccaagaacctatagaatagcttcttcttgcacacatattagacgtattaccttcaattgtatgtacagttcctccacttacatattcaactatacctacatgatttcctactccattaccatcccaatcaaagaatataatatctcccggagatggtttataacttctgcctttccatcttcctcttgccttaaaccaattagctccattatcaacatatgagaattttggaattacgccggctttaatataacctgcctcatttgcacaccatgaaacaaagcatgcacaccatgaaactctataattaaatccataccaactccagaatttttctccattataattacctatttgagcttttgcagcatttacaacagctgtacggcctctaccgtaatatgcattaccacttgagtaattaccattttttatattttcttcatatagtttatcacttaactcaatcgcttctttttcaagcatgtcaagttgttcttcaatcgcttcgatactttcatttgcgtcagttaattgatactttttagcctctgtcaacacattaagatcttctttatcagattctaaacctgcaattatagtatctaactctttcttatcgtcttctattttttttgtttgcgttgcaatttctgcttctgcctgttgtaagttacttattatactttgatcatatgaaactaactctttataattagatatattgcttattaaatcagataatccggaagaagaaaagattacatctaaatacccgctaccaccatacatatacataacttccattctttgagcaaatattttttcatatttttccttcttctcttttgctttatctaatttcttttgagcttcttcaagttctttttcaactttatctctcttagactcctgagtttttatttttttgtttaattcagaaatcttactttcataatcatctatttcgctttgaagttgatcagcttcacttgatgcatcttttaaatcagattctttattttctatttgttgttttttctcttctaactgctgctctgtagacttttttgcactaacagttacaaatggaaaatccataaaagcagtaacacaaaaaagcagtaaaataatcgcaataaattttttcttcatagtttctccaaagtttacttatagttttagtcattataatgttataatatttttcatattttgtcaaatatttactatatttttcatatttctttaaattattttataatttatttacttctataaataacaacttttaataaaaaaaacacctcaatggtgtttaatgtcgaatggcgcgccctggaagattcgaacccccggccttttgatccgtagtcaaacgctctatccagctgagctaagggcgcatatattatataaaaatgaaaaaacaatacatatgtattaccaatctattataccataagattttgtttttgcaatattaattttcaaattaaaaagggtcctcaaacgagaaccctttgggtgtgaccagattaattatttaataatgtactttacttatttaccagtttaaattaaagcataatccatttagcaattaggaatggaatccatgtaatccattgagcacctaaagcgatacttgtaatttgtgtagcgccttcaggaacagcaagacctgtgtagcttgcaagacctgtcataacatctgctgcgattgtagagaatgttaggtaaattgcacacataatgattgtttcaataatacctctgaataagttacctttgtttggtaatacagcacattgtacatagaatactaatgcagctaagtctgttaatggaagaactgtgttccatggtaagattatagcttcaatgtaaataattggaatagcaagtaatgctaatgaaataacgaatgggtgacctgttgctacggcagcatcaagaccgatgtataattctttacctgggaatctcttttcaaggaatgcttgagtcatttcagagataggcattaaaccttccatcaataatgcaaccattcttgggataagaaccataacggcagcgatgttcataccatcgattaacatttgttgaatacctgaagcgatagttgtaccagcagttgtaaattgagccaaacctgaaagaatacaaccgataacaaatcccataatcattggttcaccaagaagaccaagtttttcagcaataccttcacttgtccagtgaatgtctttaagaccaggaatcattccgattattttatcaacaggatatgtaacgatacagttacacatagattggatatgaggtaatgaaataccttcaagtccgaatacttcagcacagtctgcttgtacccagtcagcaacgatgaatataatacccatcattaatactgcttgaccgatagcaaatacccatgctaatacagggttagcttctccgcaaactaagataatagctgatgctgtaaataatacatgccagtaattccagatatcaacgtccattgtttttgtccagcctaaagctatcattacaatgtttgtaatgattacagcaataaatacgaatggaacaacttctgttgaccaagcgatagctgaaccagcagcccaaccaacgtcaaatgctgttaatgggaagtttaagttttcaactagttttgcaccgataactgaaattgcattagacataatagctataacagcgttaagtccaatgaaaccaacaccgaaagtcataccagctcttaaagcttcaccaaatttagcacctaagataagtcctaaaattgtaaagataataggcatcataactgatgcacccatgtcaattatataactaaatatagttgttacgacttgcattgtttttctcctttaaaattaaaattgtttgttttctatgttaaatattcccgcctacgtaaatcttcttataatacctaatgaatttaactttttaatgtttccaataattcatcaatacattcttgtaacttaatacctgttaagaatgcccttccattaattgttttgcaagggaatgttccaggcaaatcacaagttcctattaccaaatcaggtaatatttcatttgctttagaagcagcatcggcagctttacactgaaccgtttttacttcaatattattttgttcgcaaagtctttttacttttttggcaacgactgtagaagtagcaattgctgttccacaagccaccaatattgttttcatatctaatcacccccgattaaatctgtaagcgaaaaatattctaacctaattaattatttaatattaaattgtcaagcatctcgataatctatcgaaaggttttcattattgttacaataaaacatcaatgaaactttgttacaataatagtataatactttaactttaatttgtcaataaaatataaaagtaaaacaacaaattaaattacgttaatatatattatctaaaatcaataatattactattcacataaaaatagggagaatgttctccctattttatataaagcaataaaaacatcaataaaatagcaactacacttacataaaatgaaaatcgtgccatagatagagcctgatcgacctttttttctaacatggctattcttctttccattaaatcataaatatccaatgtttgatttttagatttttcagcttcttcttcttttaaaaggtctatgggattaataccaacattaccgcctattaaaggagcaaaagctctttttcttaaacttttcttatagctggcaagtatttttcttctatcttctccacttgtcgaatctaaatgaaactctttatcttcgtttttattctcttcgttcaaattatctttttctttaatatctatatctttgtttgtatccatattatacacttaagcttcttccgccgtcagcaataataacttcaccatggatgaatgaaggtgtatttaagaagtaaactatatcagcaacttctgtaacatccataaatcttcctagaggaactgaatcttttctcttttgtaaagcttctggatcatctttgaatctttcagccataagtggtgtcataattaatgttggagcaactgcattgattcttaaacctgtatcaccaaagaatcttgcaaaacttcttgtcatagaaactacagcacctttacttgcagcgtatacaacgcttccgccaccaccagtaaatgcagctgttgaagcaacgttaactactgaaggaacttgatcttgttctttagctttaagtaataagtcaagtaaagaaataatcatatggaaaggaccatttacgttaattcccattgttctttggaataaaactgggtctaagctgatttcttttggatctccaccaggaccgatcgcagcattgttaactaatgttgttaaataaccgtattctttttcaactaattcagcaacttttttgcaatcatctaaattagagatatcgcattttacagcataaactgtagcgcctttttcttgtaattctttttgagtttcaatcataccagcttcatcataatctacgatgataacttcgtaaccttctttaataaatttttcacaaatagctttaccaatacctttggctccgcctgtaataactacatttttcttagccattattatttcactctcctaaacattgtattttgttgtcattattatataacatatgaacatcattgtcaattactattgtaatttttatatttacatgatgacaattgtaacgattaaaaccttttttattattttgagcaaataaaaaaggtgcttaaagcaccttttttaagtatttattttactatttcatttctgggtcaaataatactttgaaacctgttacgttagcagctttattgaaagcttcttcccaatcttcaagtttcataacatcagatactaaaggtttaatattgattttgcctgcagcaactaaatcaatagctcttctccaagctgttggtttttgagaaagtgtaccttgaattctgatttctttttcttgaattctacctaaatctaagtaatctggagatggaccatggaatacgcccatttgagaaattgtaccagttttcttaacgatgtcaagacatgtatttaatgatggataagcacctgaagcttcaacaacaacatcagcaccatagccatctgttaaatccataacaagagcttttaagtcttcttcttgttggtttacacagtaatcaatacctaatgttttagcgatttctaatctgtgtttatcttggttgatacctgttaatacaactgttgagttgtttgctttagcagctaaagcagcaagtgtaccgattggtccaggaccacaaactacaacaacttcatcacagtgagtagtagttgtttctctaacagcatggataccacaagctaatacttcgattaaagcaccttcttcaaagctcatgttatctggcattgggatacagcttgttgaaggaacttctacgtattcagcaaaacatccgttctttttagaaccgatacctaatctttcgatacatacgtttgtgttacctactgcacagtttttacattttccacatactttatatgtagtcataacaacaactctgtcaccaactttaacatcagtaacatcttcacctagtttatcaacaacaccacaaccttcatgtccgataattacaggaagttcacctaatctatcagaaccaaatttccagtaagctaagtctgtagcgcagataccgcctctttttactttaactcttacataacctcttttaggttctggaacagggaactctctaagttcaagttgtctgtcttcatttaggcataagcctctcatcatttcactcatttgaattgtacctctttcttttattttactgagtctttcattttttgaataagctctttataatcagcatcatcacctttaaagatagatgatgttcctgccactaaaacatctgcgcctgcttttacgcagtttggaattgtgttttcattaatatttccatcaacggctatcattaaatccggatttctgtcatttgccatttttcttatattttcaattttaccaagagtttgtttgataaatttttgaccggcaaatccaggagaaaccgtcattgcaagaacaatgtcgatatcgtcgattaaatattcaagtgcatcttcatttgttgcaggatttaatgcaacacctgtttttacacccattcttttaatatctcttaatactctgtgtatatgtatagtactttcaggatgaacgtgaataaagtcattttcatctaaaatactacataatttttcaatatgtttttcaggatggaacattgcaaggtgaacatcgaaaggaatttttgttttctttttcatatgttcaagcatatatatacccatagctatattttcaacataatgcccgtccatcatgtcaaaatgaatcatgtctgcaccggctttttcaagcttttcaagttcccatccgaacttcatagggttaccacacataattgacgctgatacttttaaatcattcatcttatttgtcctcccctactgctttatgtattatatctttcatttcttttgttaaaggtttatataaatttctatcccctttaaaaatagcacttgttccgcaaacataaacatctgcacctgcttttgcacatccagggattgtttcaggtccaatattaccgtctacttcaatcaacaagtcaggattatatttttctttcattgcttttaaatcagcaatttttttgtattggtttggaatgaatttttctcctgagccaccaggattaacagtcataagacaaaccaaatcaatatcttttataacttcttttaaaacatttaagttagtagatggatttaaaacaacacctgctttagagccggctgctttaatagccattatacttctgtgtaaatgctttaccgcttcagcatgaatacaaatatattccgctcctgtttttgcgattctttcataataagcatcaggctcaacaaccattaaatgaacatcaaatatcatatctgtatattctttcattgcttcaagcatatatagccccatgcctaaattatttacgaattcaccatccattacatcaaagtgaatcatatccacgcctgcttctttaagcgcatctaattcttcaccgtattctaaagcatttccgcacataatcgaagctgcaatcttatccataaatgttatatcctttcataaaatttataccctattattcttacattattatacctttttttaataatagggtcaataataaaaacaaaatcctaaagaaaaggcaatatgtcttccttaggattattgtcttaaactaaatttattttgtacgatattttgcttccatttcagccattacaccaagtctttcagtaaatcttggttcttttgaatattctgtttcaatccaaactttagctatttcagccatcattcttggagcaataactctagcgcccatagttaaaatatttagttttgtatcgcttttagcaaatttagctgtaaataattcgttacatacagcagctcttgcacctggaactttatttgcggcaacagacataccgacaccgttaccacacattaaaataccacctgtttcacctgttttgtcatttacaacttcaagagcaactttttctgctattaaagagaattgaacaggaggttttggagcatcaggccccatatcgataaccttgattccccaagattctaattcttttataagtaattttctttcttcgattgctgcatgatcagaaccgattgcaatagttttaaattgaccttccattatttttctactccttctgggaagaacataatcttaccaaataatgtttttctttcaaaattagctttaaatacttcttcgatatcatcaagtgcatatctatgtgtaattattggactataatcgattaatcctttttcaagtgctgctacggtagaagtccaaggttttccagggaatccttgttgaatagcattccaagaaccatatacagtaagttcgcttcttccgattttttcaaagtattctcttggaatattaacatctccgtaaggaatgcctaagtataatactttagcacctttacatccaagaccaagtacttgagcagatgtgattggagttccgcctgattcgataacgatatcagcgcctcttccgtttgttacttcaagcacaccgtttcttgctgaattgtaatcatctattttagataatactacatctgtagcaccgcattgtttagcccattcaagtttttcttccataatatcaattgcaataattcttttagcaccgaatacttttgcaactaaaattgaaagtaatccaataggaccgcaacccataacagctacatcatccccaggttgcatctttgttttatataaaccatgatatacaacagctgtaggttcaataacagcagcttgttcatatgttacattgtcaggaattggaacaacgttaacttccggcattgtaatatattcagcataagcaccgtctcttacggctccgataacttcaagtgtcatacatcttgcatattcaccttttttacaatattcacattcaaagcaaggaagagcaggacaagcagttactctgtcaccagctttaaatttagtaacgccttcaccaacagcttcaatttgtccgctgaattcatgaccaaaagtaaaaattcctttttcagggaatttaggtccatggctacgatatctagataagtcagaaccacaaataccaacagctttaactttaattaaaacttcaccaggttttgcttcaggttttggaacatcttctaatcttaaatcttgaactccatatagtcttgcagctttcattttatttcatctccttatttattaaacaaattatttatcagcagcttctcttagagcttttaagttcttttcaacatctcctgtgaatgcaaaagaaccggcaacaattacgttcgcaccagcatcaacaaattctttaacattttcagtattgataccaccgtcaatttcaatatcaatatctctgtcgccaatcatttctttaagttctctaactttttctaccatacccatgatacattttccgccaccgccacctgggttaacagtcattaatagaaccatatcaatatcatctaaaacgtatttaagtacatcaagtggagttgcaggatttaaaacaacaccgcattttactccaaaagatttaataagcattaaacttctgtgtaaatgagttgtagcttccgcatgaacagtaatcatttgagctccggctttaacaattctttcaatgtatctgtctggttctctaaccatcatatgcacatcaaagaataagtctgtatttggtctaagcatagcgatttgatcaggaccaaatgcgatatttggaacatagttcccatccattacatcaatatgtaacatttctactttacagtcttcaacagctttaatttgttcgtttaatctaccgaaatcagctccgaaaattgaaggtgataattttaccatttttcttttctcctttaattatatttatttcttattaccaattattataagcatttatgtaaaaattttcaagcattttgcattattttccaaaagaaagaaataataatattttatacgatttcatcctttttatttcgcgttttttttatttaatttataaatttttatgataattttataaaaaacaatcataaaaaaatcatgatattgtaaaaaaaacttttaaatgatatcatatttatatgaaagaaaacataaaaataaagtgggaagataaaccttattacgcttttaattgcatgttaaaagaaaggtttaacagaaaagtttacaaagtttcaattaacgcaggaatgacttgtccaaacagagacggaaaaatagatacaagaggatgtatattttgcagcagaggaggaagcggagattttgcgggtaaaagtaaagaaagcatacaaacccaaatcgacaaacaaataaaaataatgcaaaacaaatccaatgtttctgattttattgcttattttcaagcttatacaaatacctatgcaccacttgagtatctaaaacaagtcttttacgaggcaataaatcatcccaatattgttgctctttccatagcaacaagaccggattgtttagatgataatattattgaactaataagctcactaaataaaataaaacccgtttggatagaactgggacttcaaacaatacacgaaaaaaccgcagaatatataagaagaggatatgatcttaaatgttttgagaaagctgtaaacaagttacgaaaagaaaacatagatgttattgtccatactattttaggacttcccggagaaaatagaaaagatataatagatacaatagaatacttaaacaaaaaagatatacaaggcataaaacttcagcttcttcatgttctaaaaaatacagatcttgcaaaagattatatagaaaacaagtttaaagtttataccatggatgaatatattgatatggtaattgactgtattgaacatttaagaaaagatatagtaattcatagaataaccggagacggaccaaagaaaattcttattgctcctctttggagtggaaacaaaaagaaagtattaaacactcttcatcatgaatttaaaataagagaagcatatcaaggtaaaaaatacaataaaaattaggtattaaaaatattaaaaatacatattgaaattttcttgttttatttttataaatatagtcataaatataaaataataaacaataaaaaacacactgctttttgcagtgtgtttttattatatacattaattatttttcaaattcttcttttaatttttcaccccatgcgccgccttgatgatagaagagaacctgctctcttgtaacacctctgatttcttcgcttaccatagctaaagcatcacccatcgcaagagtatttgttgttgaagttgtagcatttacacctgttggacaagcttctttttctactcctatatataatgcaacgtcacattgctttgcaagtgtagactctgtatttcctgttaaacaaattgcttttgctccaattgtttttgctgaaggaataaccaattcctttaaaatatttgtctctccgctgtttgaaatagcaataattaaatcatttggctgaatagctccgatatccccgttttcgcagttgtaagcacttaagaaaaatgcaggcttacctgtacaacaaagtgttgcggcaatttttctgctgattaaacctgattttcccgttcctgttaaaataattttacctttacagtcagttatcatttctacggctttaacaaagttatcatcaagagaatccattaatcttccaagttcatatctctccatttcaataacttttttgccttttgatattatttcgtttttttccatgctaaatcattccttttctgtatctgtatttatataaatacattatatcaattttgatgtttttttcaatatgtttcgattagtttcaaaatgaaaatatttcaaagtatttaaactatatcatgatgctctccaataacaaaacagcacaataactattttaatcaacaacctttttatatatattctatttttatttaaaataaaaagaaaaaagagagactatcctctcttttttctttttatgctattttctaaaacgtttatctctgattaacttgctgcttacaattccaattaccataaatgagcataataccaagattatgtataaattaatattattcatgtccgaagttgctgcactgtcggtatcatcggaagatttacgtgttttgtcatctataacaacatctctgtaattagttatagtatagccatcatatgttaccttatatccatcagggacctcaacttcttttacggtataaacaattcttttatttaatgaattgtattcaggcagattttcaaatacatattcccatgtgtttgtttttccttttaaggttgcttcgtcaacttttacattatctgcataaagttcaaccttaatatttttaggacgtactttatcataattatccatatcatcccaaacctttttaataggaatgtttatggtatcatttaatgtatttgtaatattatatccatcataagttacggcatattcatcaggaacaacttcttcaacttcataagtgtactcttttccactatcatcagtcacaagaagcccttcaaatttatattcccattcatcgccatctttgcttatccatataggttcaaaatcaagcttaactttatcttttccgtctatacttctaaatatattaatttgtatatcttcaggtcttgtattgtaagcatttgaactgtcaagccatgtttttttaccggatatttcttttttacctatattggttattgttgttttaccattctcatcattatttaatatgcgataatcgtaattttctatacctattccgtctatagaaatttctcttgcataataagtatattcgttgcctgctttgtcatacttaggaagatttcggaatgtccctttcaaattatttttcgtaagaagcaatgtcatttgatttgaagtaccgttttgcattacaggttcactgctgtcatctccgatttctcccgttgttctgtaaagtcccactcggacgattccttgatttgctgattcaacaccataccataccttttcaacattataggaagtagattctacatttgtaaattcaaattgtatatagttacctatgctactttcgcccatactttcctgcaaatatccgcttggcacggtttcaaagactttatactgcgtatgtccctttatatcaagcttgcttccgctcacaacaagaggcaagtcattccaaaccgctttccattcctcatattcgtaataaggtttgcttggatttgaatccgcctctccattaagagttactcttgcaggtgttttaaaagatttccaagtcccgtttgaagcaaggtattttatttctaaagttacatttgttttatttgaggatggattccatttcttcaaagcataaacttttgttgaatcaagggtatttgttactgtattgctattataagttgttgtataagtagagttataagtattatctccattgtttccaacaatatcttcatctttaacatgcccgtctgttaaagtgtaattgctgtccagttctcttgccctgtattcatattcatttccgtttacatcagactttggaagtccgcttacggttgttgtaacactgttgtcttcatcgctattagttccatatatggttacaatcatatctttacttgtttgattgcttgcatatatttcaacattttcccagtcacccgcagcagatttcctttgtacaataaagcttgcctgccatgtatatccgctttgagatgtttttggtctttgagaataaatattgttattatctcctacccaattcttcgtaaattcaaagctcgttgtttccaaacgattatacataacccttgtagcattattgttatatgttgtttccggttgatcttttccatttgcccagtatgccggagtaaacattcctccgttaaagttataaatataaccagagccattattagtttcaacgactgttactgttgtaggacttgctacactgtcatcactaccataatgaattgttttttctaaaactctgtactgaagccttgtaacttcattgtttcgagcatctttttttacaataattcttggtaaattcgcataacttttatttacgccccatattgtactgtcgtttattcttccggttaaacttctatcaaattgataaccgttaaatattgcattataattcgcttcggttaaattatctttaaaatattcataagcatttttataacttttatccgaactatccatttcgcttacttgaagttcaaaatctaccgtaaggtcatatcctaaataatcattgtctattatatttccgtcattatctacccagtttttactatatggaatatttgttgtaatattatttgataaattattcataataatattactgttatcattttctctcctattttcagttacttttcctaagtaactattaccacctgaaggagaaacgatataatttgaatcagcagaaagagtttctttcacaacatatttccaaaccataccatttggagcatatttttcaagctcacccatagcatcacctgtaatttcatatgtccaattattttcacctttttgagtccaagttatttcatatagactttcatcaaccttttcttccgaaatagagttaccctgccctggttgttcatttgcatatttataaagggtaagctcaatatcaccaggtctaaatccaaaagtatctttataatcattccatactttcgtccctcttatattaacagtatctctcacatcatcaggtgcatttacaaatgttgcacttggggcaggaccaaacaatgattcacttgaaggatataaatctccggtttctattccggcatatgtatcggtttttatattaggaatattttctttttccaaatctgtattaacaacccagttatcaatacctccaagataattcttattttcttccactgaataaacatatttggagccgtttggtgcatatatgtccaaatcttcaaataaaatttctttttcaagagggtctgcctctgttcccgcatcaggattcaaaccaagcaaatgcttagtttcatacgcattttgaacttcatttgccgtccatgtcttatacataacagcttctttctgcgaggtagttccgtcatttttcgtataagtacggtatagtgtaaatgttactccagggaaagctttaggatctccgttttcatcaaatgaaagttccataaatttctttattgaaagctcgccttttttactgttatatgcattttcaactaaataagtatggttatctttattgtcaaatacatcttctattgcaggatttgcaccgtccgcccaataaatttcgctttcttttaattcataagaatatagcttaccgtcttcattgtatttaggtattttctttgcctctccttgaccggcatatatagtatcattatttgaatctaaagcattttcacccaaatataatacttggaataaatatgaaccgtttttatatatatctgaccatttatcaaccgttattgttgctacaggacttccatccccgctttctgatgccagtttttgatacaaagtaaatgtaacgccaggcaagtcttcatttggataagaagaaggtactgcagaccatattttctgaccttgaattgttaaatcagaatatattgtattttcaaatataccgccttcaattaaagcatagtttgcataatcagatacgtttggcttatcttgaacatttgataaatcaagcacataatcttcatacttgctatctacctcatctctcgttcccaaatatataggattattctgagcgttttcatcaattacataataattccctacctgataatcaaactttttaaaatctacattagttctttcaacggcataatacataatttcatatcccaaatcatcatattttggaacattattaaagagtactttccattgatcaacaggatcactaccctctatatcactataaacccatctataattagaaacatacaatgaagttttttcctcaacatttccattttcatctttttcatgagttacttgataaatatcaagatacaagtccattctatgtccgttttcgaacatataatcatctttccatactttttcccatgataaagtttttgaacccgttaatgcattcctaatgctaatatcctgtgtatcatttgcaaaatgatctccgacagtatactcacctgatgtaatagatgaagaatactgactgtataattcatataattttggatatttattctttatcgtagaaagtgcaacatatgttccgttcgaatctacccagacttcgcttattttataacttgcaacagaaccggatctgttatatttaggaagattaaagaaataacatttactattttcaccgtctgcccatagaattttttgtgttgatgaaacattatttccattattatcttttatggcaacatagttatcagaattgcctataacaacactgtccgcattatcaacaccgtttcttgttatcttataataagaaggattattgtcggttgcaaaatcaagctgagcaactaaagaaagagaaacattttggttttcttcaatattttgtaattctttttgaatctcacttctaagagaaccgtctccgtcaacccatgttttttctactgttaaatttatatttccaagtcttctgttaacggctttatatactttttcaccgcctatttcttcgctagtatattttacgtcatatctatgatattgtgtctcatattgaattgacgtatagttggtatcaccttcgtcatcatattcatccggagctttaggattatcatagttcggagtctgtccctgatccaaataatatgtatccaaaggaatatttgtatcccctacttttgtttccaaaatatagacgttctcttcatttaaattgcctataccgacataatcataccaaacaccatcacccaatgtaacttcatttattttttcattggtttctctattgtatacagaaattgttacattttctctatgtgcaatatcgctgtcgtctatccagccttttgcaacaagtattctatttccaggtcccggtgcattgacaatagttgattcatatccttctactgtccttgtggtttccatatcaggtaaataatcctgatttgcttctgttaagaaatattcatactgcattccttcttcattaaattcatccaaaggcgttacccttaccatccaaggagaaatttcctgtgcatatattccaagattagcatttaccaaagttttatcagtatcgacaacaccgtccatttcaaatacggcaacgggatcatcatatgtatattcattatttaacatttgataaatattaaacttaatctttgcccctgccggagcattaatctcatgcccatcggcatcatgccatttttttatcacatcatattttattgtgttttctatggtattggtaacaatagtatgctgaggattatcctcatctattgtcggagttgaaagaaattctatttccctgttatccaatgtaagggcaaaagttccgcttccgtcagcatttgctttaaacaggttgcttccgcctgctttatatacaccgctttcaacccatctgtattcaagttccctgcctagattgtcgtatttaggcatagattttgtttttgtgtcagtcaaattttctgcatagaaatcatccattaccaaagtctgggtcgtattaatccacgtttgtgtgccttttactctttgttgtaatgagaattctacactgacatcatcaaatcctgattggaaagatgaagcttcccaaatttttgtaacttcggttgaaatggttccttttattctgtttgttataactccgccgttatatataaaatcattattatttgctctatctgaagtgtttgtagtatctttaatttctccgtttatatcaactctgtctgtaatatttccgttttgatcaacacttccaaaaacctgctcataattttctgcattttcaccttcaagatactctcttaaaacataaaagtattcatatccctcagcgtcatattttggtaaattaggacttccatttaattcaaattctatatattgaaaatccactccatcttctaaatctttttgtactatttgcccgtcatcatttcttacaacagaagcagttgaaaaagatgtaccttcacgatatctccataattggaaaataccgcttggtctattttgttttgtttcagtcgttccatcatcaagccaaactttttttgcttcgtaggttttctcacctgttaatgttagtattacagttccttcactatataaattatctatcctagagccatagttaagagaagaagaattgtcataacttacagacaaataatcatcctcatcaaaagcattttcaacataaaccttgttgtcagcattacctgaactatcaggaatctcttctatataataagtaattaaagagccatcaatattatatttccatgtattatcaatagctaatgtcatactgtcatcatcaggatgatctgttaaatatgtgttttcaaattctgatagaatatgctcttcatatcttctattttttatttctattacaagacggaaatcatttaaaagggcatcacttacttcttcccaatgatcattatcccccattctggcaacacaagtaaagcgaaggtctctaagtaaaatgtaataccagcctgtattatctacagaaggatattcatttttattttcatctgttacttcaaccatcgcatatccgcttacatcagtcggtatgatttcccagcttacatcatatgaagtcttatttccataaatatcttcataggtaacattcgatggtaatacacggtttcctgccgatatagtatatactccaacacctgtgttatctacagaaaacttaggataagactgtagccccacttcttccatattgtctttggttaaagttttatacgtttttccatcaaaagagaattgtaatataggctgagaataggaagaaatattaggtctgattgaagattcgttgttgttatccacccaaaaaatttctttagaaaaatttgttaaatagctatttattgtaacactgtcttctatagctttgttttctaaactttctgtttcttttaaagctttattttctttaatatcattatttaaatcttctttttgttcttctttggttattgtaattttattcgtatttttttctacattaacgccatcaattgcctcactgctttgtcccattgcatttactacaatatcattttcatcaacgttaattgtaaaaggaagcgttaaactacttggcacattaaatttatattgataagataaagaagaattttccttatcaagtccaatcaccaaatgaacacttttatcttcttccattttaggaagtatattatttcctaaagagtcaagtccattttcgctattttctacttcacttttaaaagcatcttcatttaatttcaatccatcttctgataatatacctaaagcaattgcttcatcatttgtcaaaacaatctcaacacttacagcattaatatctttgacattatcagtattaagcttagcttcaatgttaagtatcccttcttgcgaagaagtaatttcactgttttcaaattcccaatctacatatacgtcattagtgtcaacttcttcaattacgttagaatctttttgtccatttgtatcaaaaacatcatcttgaactttcgcaaaaatactcgagggcaatgatgtaaaaataattaataaagacaaaaaaacacaaaacaacctgtctttcaatgttttctttttcataaccttcctccatttcctgtcttttaaataaataaacgaactaaaatatatcaacatgaacaaaataaagataaaagtaaaaacattaaaattttatgtataaaaatacatttacaatatgtatgcatttccagaatttaagcaacatatattattacaaatgaaatttataaactttgtcagaaaatgtatatataatggaacaaataaaatatattacataaaagaaatttttttaaataaaaaagacaaaaaaaataaataataatactttgtaaattttaaatgtattattatttatttgttacaatttgtatatatattttatcacaactttaaacgtttaaccatagtacgttttttttataaaatgtactatgaacatattatttgataatatttcatttttaagttaaattattatagaacataaaaatgtaaaacaaaaaatatttttttccccatgatgatataaaattgtgaaaaagaaatattatgaaaaaagttataaactgtcaaaaatatttttgtttgaacttaaaagtatttatctaaattttcataaatctaaataaaaattgataatgaaaatattaaaggggaaatattttttatatttcccctttatttacttcatttaaacaaagcagcttagacacatttatataatagtgtatatcagaagtatctgcttttatatatttaatttttctcagatgccatctcttcttttttattattcttaaacatagttactatggattgtctgtttatttttaaatcttcttctaaagcttgcactgttggttttacaatccaccagccttttttagaaggtattctgtatttacttggtaaattaggaacgtgttccacccatttatcataaatttgttttgataaatcatcaatacttatagatgaattgtttttaagtatctttgaactttcaataaatacaaaatcattaaaatctcttggtatccattttttcgcacaaaccgcaccataaaacagaacacaaccatataaaaagcctatacatccaataatatatgtatgctcaactatccattcataaataaaatatagatgttcgccaaaagacattcgcatcagaaattctactattattaaatacattatacgtctaactccttcttaaagagaatattctcttataacttattatgcttcttctacttgtttagctaattcgtcttgaacgattttcattattaactctttatctttagattcataaattgattttaatttatcttcttgttgaattagagaaataactgtttgtaacatagctaattgttgatgtggttcttttaatgcaagcataaataaaattgaaacttcgcatttttcaccagcacctgccattacttcaaaagtaacaggttttttaagtgtagcaacacaaatgctttgtttgtttacatgttcaacatctgtatgaggaacagctactgcaaaatcttctacaggtaaacctgttgcgaatactttttctctttcttttacagcttcgatatagctttcttttacataaccaagatcaaataatttatgagcaacttgatctaatgcatctaaattactatcagcctccacatcgaaaaaaattagatctttgttaaattctaaatctgccattggtatctcctccttaaactatctaaatataaatagctcttcatataattattttaattaattataaaaaaaaaatttttaaatgtcaataagtaaacagtatacccttttgaacatcatcttttaaagtgcctatataaacggttttaaaggtttaaaaatacaaaaaaataacatttttatattaaagtcgataaatttagtgtaacaaatgtaatggtaaaaaaaattttgaacaaaagtactttacaattaaaaacaaatgttatataataacattaaattaataagaaacatatccaggaggaaaaaatgagtcaagatattcaacaattaagagaagcgatttgtgatgtaggacgtaaaatgtacgacagacaactttgttctacaaatgatggaaacatctcaattagattagaagatggtaacttcctaatcacaccaacaggtgtatcaaaaggtttcatgacacctgacatgatgtgcatcgttgacaaagacggtaacctagtagaagaaaatggtccatggaaaggaacaagcgaattcaaacttcactacaaaatctatcaattaagaccagacgtaaacgcagtagttcatgctcatccattatatggtacagtatttgcagctgcaaacatgcctttagataaaccaatctgtacagaagctgcacttaacttaggtgaaattcctgtaatcaaatatggtttaccaggaacattcgatatatgcggagatattgaagattatatcgaataccatgatgcagtacttatgagataccatggtgctgttacatacggtcctgatgtacttacagcatactacagaatggaaagcttagaattcatcgctcaacaagaatttgcagcaagagctatgggaatcgttgaaaaagctacaattcctcaagatgttattgatgaattatatcaattaagaagagaaaaatattcagctccagattcaatgggtcctcaccacattgcaaataaaaaataattaattttgaattaaaagaaaggcttttgcctttctttttttattatttaaaattttatgttaaaatatctataataaaagtatagaggttaattatgtacgaattaataaaggttgggaaaaacacttactatataaaaagcgaaaacaacgtaggaatttataaaataaatgataatgaaatatttttaatagactgtgcgatgacaaatatccaggcaaataaaatccttgaaataataaataaaaataactgggtattaaagggtataataaatactcatgctcatgcagaccatataggaaataataaaattttacaagataaaacaggttgtaaaatatattcaagtgaatttgaaagccattttataaaatatacagtacttgaaccggcttttatttacggagcatatccaccaaagagaatacaaaaaaagtttttaatggcaacccctactgaaaatttatcatataacctaaaggaaatcccaaagggaatggaaataattaatcttcccggacatagttatgacatgataggaataaaaaccgatgatgatatttattttattgcagacagtctcttccctatagaagctttaaatacttaccatatcccaacaatatataacatagaagaatttctatatactcttgaatatttaaaaacactaaaaggaaaacttttcattccaacccatgaacaagcattaacagacataactgagcttatacaaattaatgaaaataaaataaaagaagaacttgacttaatatgtaagtttttaaaagttcctttaagccttaatatgataacaaaaaagatgtttgattattataatattgaaatcaactttgttgaatataatcttgttgagggaacaataaaagctatgttatcttatttgatagataaaaagaaaatagatataacttttaaggataattttttattatataaattgaggaaataaaaaatgaaaataaacaatgaatttttaataacaacaaaaaaagaaatggaagaaagaggaatatcccagctcgattttattatagtaacaggagatgcctatatagaccatccctcttttggaactgcaataataggcagacatcttgaaagccttggattttccataggtgttatccctcaaccaaactggaaagaaaaagaatcctttatggtacttggcagacctaaatatgctttccttgtaaacagcggaaatatagacagcatggtaaatcattatactgcatcaaagaaaaaaagaaacgatgatgcatatacagaaggcggagtcgcaggaaaacgtcctgacagagccgtaatagtatattgcaatatgataagaatggcatacaaaaaagttaatataataatcggaggaatagaagcaagccttagaagatttgcacattatgattattgggacaacaaagtgagacactccatacttacagactccacagccgatatgctgacatacggaagcggagaaaaaatacttggagaaattgcaacaagactaaaaaacggtgaaaacttaaaagatataaccgatgttaaaggttcttgttatatgacaagcgatataagcaatattgaagatgcaattattatcccttcctataaagaagtatgcttagataaagaaaaatataataaggcttttaaagttcaatatcaaaaccaagacccgataacaggaaaaacaataattcaatttatggataaaacttatcttgtccaaaaccctccaatgatgcccctaaacagagaagaactggataaagtatacggactgtcttatgcaagaaaacctcaccctatgtacaaaaaagaaattccggcaataaaagaaattgagttttccgttacttcaaacagaggatgctttggtaactgctctttttgcgctctaacatttcatcaaggaagaatggtacagtcaagaagtaaaaaaagcataatcgacgaagtaaaattgcttacaaaaatagacggttttaaaggatatattcatgatataggaggaccaacagcaaactttaaaaatccttcatgtcaaaaacaaatgaaatacggaacatgtgttgggataaacaaaacttgcctatctccttctccttgcaaaaatttggaagttgatcacagcgaatttttagatgtgttaagagcagcaagaaatgtaaaaaacgtaaaaaaggtttttgttagaagcggcataagatatgattatcttcttttagaaaaagaccctacggttttaaaggaacttgtaaaacatcatataagcggacaacttaaaatagctccggaacatataaacaataaaacattaaaacaaatggggaaaccgggaagagaagtttacgaaaaatttgtagataaatacaacaaagtaaacaaagaacttggcatgaaacaatatttggttccatactttatttcatcacatccgggatgtaccatacaaggagcattggagcttgcactgtatatgaaaaaacataatatacgaccaagacaggtacaggatttttatccaacaccgggaactttatcaacttgtatgttttatacaggaaaaaatcctctgacaaatgaaaaagtattcgttccaaaaacatatgaagaaaaacaaacgcagagagcttttatgcaatattacaaacctgaaaacaaagaaagaataagaaaagctcttataaaaataggcagaacagatttaataggtccttatgaaaactgtttggtatttgaaaagagagaatttaaaaataataaaaacaataaaagaaaaacatcttctaaaaaattaacaaacaaaagcggcaaaggaaaaccaaacagcagaaagagaagatataaataaaaaacattttgtgtttccacaaaatgttttttatttatttataaaagaatttatttcatttgaaagtttcgcaaattgctctattgttatgttttcagctcttactttttcatctaatcctgaatttatcaaagcttgttttaacaaatctttatttaaagataatccgttagcaagagaattaaaaaccatttttcttctgtttaaaaaggcagctttaacgactttaaaaaatactttttcatcatcaacttcaattccttctttttttctcggtgtaattctaagcaccgtagaatcaaccttcggcattggaacaaatacagttttaggaacattaaacaatctttcaacatctgcataataatcaacaacaaccgtaaaagatgaataatcctttgaatttacttttgcgttaagccttgttgcaacttctttttgaagcattacaacaatattattaaactcaacttcatcttccaatactttcataagaattggagatgtgatgtaataaggaagatttgaaataaattttatttttcttccttcttttatttcttcagctaaaatatcttttaaattggttttaagtatatctttattaataatttgtatattttcatattcacttaaagtttcttcaagcatctcaacagctcttgaatctatttcaacagcatacactttatatgctctatctgctaacttttgagtaagactgcccataccgggaccgacttcaagaacagcttcgtcatcttttaattctaaggcatcaacaatttttaacactatattttcatctgttaaaaaattttgtcctaaatcctttttaaatctaaaatcatattttgatgttatttcgtttattgtatttttatttgttgctttcatattttattttcctataacacttcttacttcatttatattaagaactttagtaatatatattaatgcaaagtaaacaacagcagcaacaattattacaattacagttaaaatactgttgcctacaaaacccgcaaggaatgtttttaatataaaacatataattcccattacggctgcacaaaaaagattttttataaaagccataccaagacctctataagtagaaccaaggaatttctttattgctctgtaatcaagacttgccacaacaaagtcagcgcctaaagttccaagaattgcaccgtaaatattcaagaaaggaatctgtattaatattacatttaaaacaagttttataacacaacccacagctaaattttttacaggaacttttaaaagtccaacaccttgcaatatcccctgcattgtagttgatatcatagtaaacactatgccaatggataacaatctaagcatatttgctccgttagcatcgccaaacaataatgttgttacctcacttgccataacaataagaccggcaatacaaggaagagcaagcattaaaacaactttaaaagttaaaaatgttttttgtcttatctgctctgtgttttttcttacaaatgattcagaaattgtcggaaccaagctggcagcaagagatgaagacaatataagaggtatacttataatagtctgtgctctttgtgataattgcccccataaaatcgttgcttcttcaacactaaatcctgccttttgtaaaaatgcagaaacagtaaatgagttaatcaaattcattgaagaagtaacaagagaagcaatcgtaattggaattgcaattgctgctaaaattttaagtatggtttttacatcttcggtagactttgttttttgattttttatttgtctttttattctcggtcttatctttaaaaaacataagaataagaataaactggcaaccaaagcaccggcagtagctccaaaagtcgcaccggcagcaccaaaagcaacaccaaattgtttatataaaaatacggcaagcccaagtcctacaacaacccttgttattgattcaactatttgtgaaatgcttggaggtgtcatattttgcataccttggaagaaacctttaaatgatgacaaaatacaaacacaaagaggcgcaaaagccaaaccaaggattgaataatacgtatctggatgccacttaaatattgaaataaagaaatgagctccgaataacataatagctgaacatactgcaccaattaaagcaagagtagtaacagcaactttgaatactctgtaagctccatcgtattttcctaaacttattctttcagaaaccatttttgaaatagcaaccggaagtcctataacagaaatagcaagtaaaaatgtatatacagggtatgcgtttccgtataaccccataccaaaatcgccaagaattcttactaaaggaagttttaaaaacatcccaaggaactttgcaactattccaccaaaagcaagaacagcagcacctgttaaataatttttctttttactagcgctcaaattaatttcctcctgaaaatagtacttcttctattataaacccgaattactaaaattcaacaattttaactcttttttaattttcccataacaaaaacaacatcttcgggaagctctgctttaaattccaccatctttttacttcttggatgaacaaaagatattgattttgcatgtagagcttgatgtgaaatcagttcacttttgttttcgttatataatgtatctcccaaaataggatgtcctatataagcgaaatgaactcttaattgatgagttcttccggttataagttttgcctcaactaaagagtgtccattaaattcctcaattactttatacttggttatggattcttttccatcttcactaactattctttttaaaacatgcccctcttctctttttataggagctgatatatagccttcttttttatcaagtattccttcagctataagaagatatcttttatctatttcatttcttatactttgattttgtataaaatgatgaacatacttattttttgcaataacaacaagtccagaagtatccatatcaagtctgttaacaaaccttgttttaaaatgtttgccttctttatcccacttataataaatggcattttgaagagtatcgagaggatgtgaacgggtaacatgaacaaccataccgctttctttgtttataaccactatatcatcatcttcgtatatgatatttatatcaattttacttgatggtgcatcagctttttcaatagggaaaaatatttttatattatcattttcttttaaaacatcaacaaacaaagcttctttgtcattaacaagaagctttccctctcttattatatatctaaaggtcctggaagaataatcatattctttttccaaaaaagaatagatattctccccttcatattctttacctactgtatattcgtataccgtactgaatttattagtatttatcactttcaaaatattcctctaaagttaaattattatcatgaattatttttgctaaatcttttccgacgtatcttatatgccaaggttcatagctatatcctgttattttttccttattttcagggaatcttattataaaaccatatttataacaattttcttcaagccattttcccgcaggagtatctcccaaactttccacaagctggtaatttacttcttttgtacttaaatccatagaaagccccaattgatgttcactctctcccggtttggcagagtaaaaattggcatcttcttcattaccatactgggcaatattatctttataaacatcaacttgtaaactatatgacctaaatccgcttacaccataaaatttataaccagagctttgagcagctttacaaagttcttcaagtgcttttgcagcatcttttctaagatacattacagattcattggactgcataaaatcaatatttggctttacaaggtctgaaggcttgtaacttgaagacaaatgtctttctttattaacaacggcatcatattcattagggttagttataatcatattgttatcaatttcctcacttaaattatcttttatagtataagtatatgatttacttaattttttataactaacaaccatatttaagacactgccacttgtaacactatcatcaatattaattacatttttatttacactaacattattttttaaattttcacttgtcacattaattgtaattaaacttttatctacattatcaattactttattattaaagtggtcttctatgacattttgaacattaaatgcataattggtaccggtttttatagtctttgtatcgacacctataatttgagtcttatatgttacatcacctcttaatgttacatctcctactaccgtagttttaaaaggcttgtaatatgcaatgaaactaaaaagaaaaacagtaacaaaaacaaaagctataaaaaatatacgctttatttttacaattgtacgtcttcgtcttcttgcaatccttcttcttgtataaaccgtcgaagtacgataactaccataagaagatcttctttcgtaaggctcaacccttttaaccggtcttcttacagcattaggatttttcctaatatgtcttgtatctcttttattggatacattctcccttcctgctatcctttgtaaaaaagtacctatattatatttaacttgtttttttattcttttcaattgtctgctaagcccatcatttctttttcgaatacgaacttttttccttttattagaatgattttgttcatatcgaaaagaatcagagcttaaagagctacttttatttcttaaagtatctctcttttttccattaaaaatatcttttaatgcttttcttttctttttactcatcccatttgcttaaaacttcttttattatttttggtgctaaagcacacttttcttctccaacagcgcaaagagcaaatctaagccctgtttgaagaggaattacaaaaacattttcctccattaataaatctgccgcttttaccggatctttacacggaatacaaacaaagaaaccatctttgtaaggatataacttaaggcctacttcctcgcttttttgtaaaaacacatcagctcttcttctaagcatttttacatagtggtctctttccttaataaaattattgccaagattttcatcatttataatatcagtaagaactctcatggcaccttttgttccgtttgaccaagttcctctgtttgaatgtaaatttgtatagaaaaattcttttgcaatttcttcttttgatgttacacataataaagctccatttctaagtccatacattgtataaccttttgaagcagagaacgcaaataaaataagaatattttcatcaagacccgcaaatttttccataaatttacgtctattaaatttttcatcgcaaaaatcaatatatgcaatatcaacaagaacaattattttattgtctttatcctttgcagcttcttttaatactactaaaatttcatcccactcttcatctgaaacagaatatcctgttggattatgcgcaggtgtattaaatattgttaaaagtcttttttgtttagttaaataataattaaacttttctttaaaagcatcaatatcaagtccgccattttcgttaaacatattatatgtatcgagttttcttccgctttcaagacaaattgtgttatatggatcccagtataaacttgatgttatgaccgtatctccaatatttgtataattaaatacgctgtgatgtattgctcctgaacctcccggtgtcgcaacagcttctatataagcgtttggcatatgatctttaaaacatgctttttttacggcctttaaaaaatctttatcaccttcaatacttgcataagcagctattttaggtgcttctaaactttctaaataatcataaacacttttaaatgccacaaaatctccgttatcttccaaaagtacgcccattgatgaatttatcaccttgtcaggaccgtatttttcaacggcttcgcttgcctttgctgaaattgtaaaaatagtatcattctctacgggtcttatcgcatgatccgcaaccatattttttgacatatcttctcctcccacaccatttaatatcatgattatatcaaaaattttttttaaatagtagtaatttaaaaaatttaaagtataatatagtaaaaggagtgatttaatatgaaaattaacgcaaacaacagctataaactagttaaagaagaagttaacaacacatacgaagtattaaaagacggactttctatggaagaaattacagacatattacttcatgatcccaaaaaacccgttatgggaatgtataaattattcatgacaattgcaatagcaaacctagaagccagaaatgatataatggaagacagggttttaactaaagcagctatttatatggattattttgccaatggcggaaaacaagatgaattttttatgacaaaacaagatttattatatgacgatcttgaatttataagaaacaaatatttaaaataatcttataatttaatatataaataataccctgcaagtatacaaaactatatttgtgggttttttattaattaaaacaggtaaataaaatgataaaatcaattttagctaaaacaattctttctggatataatcaatcaggttggttttgttcaaattataatatgaatttatatagaggatgtgtgcatggctgtatatactgtgacagtagaagcaactgctacaatatcgaaaattttgatgaagtatcatataaagaaaatgctataaatatactgcaaaatgagctacgaagtaaaaagaaaaaaggcgttataatgacaggagcaatgagcgacccctataacccttttgaaaaagaattaaatttaacaagaaaatcattagagcttattaacagatatggttttggtgtaagtataataacaaaatcagatttaatcacaagagatatccaaatactaaaagacatagcgaaacactcaatagtctgtgtgaatattaccataacaactgcatcagataacttagcaaaaaaaatagaaccaaatgcgccatcaagcacaaaacgctttaaagcagtaaaaaagcttaggagcaataatattacaaccggagtgttaatgaccccaacattaccatttataaatgacacaaaagaaaatataatcaatatggtaaaacttgcaaaaatatataatgcaagctatatttacgcatataaagatttttgtgtttcattaagagataatcaaagaatgtattattattcaaaacttgatgagctttttccaaaagtaaaagacaaatatattaacacctttcaagataaatactggtgctgttccacaaacagagaaaagctttgggatatatttgtaaatgaatgcataaaaaacaatattgaatatgaccataaaaaaatagatgaaataattaaaaaaggctataataaaacacaaatgagtctattctaaaaataaaggaaacataaatgagcaatatagatttaaatttacatgactttattcaaataaacgatatacaaaatatagtcaatgaagcaagagaaaatgatactgatattgaagaaaaaatcataaaaaatcaaaaccttgataattatgatttttctaacataaattttagtgatactatatttgaacattgcagatttttaaattgtgattttgaaaaaagcgcttttgtaaacgtgattttcaaaaactgcgatttttcaaatagcaattttagtgaaggttatttttcaaaaatacattttgaaagttcaaaatttctcggtggtgattttaacaaagcaattataaaagatgcagaaattatacactcaaatttgcaatatacagtattcatgcagacttcttttaatcatgtaaattttaatttttctgattttacaaacgcaactataagtgatagcactatgaaaaaaattaaaataaaagaatgtaaattcattttaacaaacttttttaatacaaaacttgcaggaattgatttttcaacaagcaatattgatggtatagttttatctgataattttaaagaattaaaaggaattaaagtaaatgaaatacaagctatagagcttgcaaaacttcttggaataaaaatagtttaaaaagagggaaaatatgaaaatacaaaaagtaaatttaaagaaagaacaatatcttgatcttttatatttaggagatgaaaattacgatttaattaaaaaatatctaagtaaaagcgatatgtatattaacctttatttgtaaactaatttacaacataaacataatataatctttaaacacaatagttttaatgtttcactataaacatttatactttaaaacctaagcaaattttatcctttttttattctttagtggcttaacctttcttataagctaacttacaacctaaacatagtaaccccttaaacacaatagttttaatgtgtacttttaaacacttataccttaaaacctaagcaattttttatcttaaacttcaaatatacctttagaactaagcaactttttatttttttaaaatttttaattacttagcctttcttataagttaatttacaacacctaaacacagtaaacctaaaacaaaaagcttaatatataacaaatcatattaaaaccctaattaaattccctattcatatattaaaatatttcttacatatgattacatttttattaaatcagataatataaaaaaactaaaaataagattttatttattctttttttcacactcttcgcaaatcccataaaaaactgttctcttgggatttaatttaaaattatgggtagtatataaatgtttttgaaaatcatctatttcatgacagtgaagatgtataagttttccgcacttttcacattttaagtgaaacagcatatcttcatgtctgcttttcccctcatattcaaagcaggcaggagtgtttatatctataatatatttattcagtatcccctcatttaccatgctttcaagctgacggtatacggtggattttccaatattggaattttctttttccaaatactctaaaacatcacttgccctaaaatgttttttatccatattctcaaaacaatcaataagtatctttctttgttttgtattataatgtgaattcataccccaacctctgataaaatgagaatcattctcaatttaataatattttgtagattatatcattaaaaagactatttttcaacgaatttgagaactattcctaaatttaacaaaaagtttagaattattaaatttatcaattattaaatgctgaaatttataataaacttaacttataaaatccattaaaattttataactctcttaataaccataaatagtattaaataaaccaatattaatcaactaaaaaagacacccatatttataaacggatgtcttttttattaatctttattaatggaaataatacaatcctgaaaccttgaaataaaatagttacaagatagcttttgtttgtaaaatataaataccatttttcgtggcttttgaaatcctcaaagcatccactcccaacagcatccttttattcatttttaaacaaataaaacggggcggcggtagtggtcgtttcaaaatctcggacagagatttttagaaaatccgaccacgttataaacctttttcccaataactccattttatttccaatcaaacttataacctacccacaaactaagtcgggtcggggtagcttttctgacagtaaaactcgggcagagttttacgcagtcatcgaaaagcgttataaggcacttcgccgagaagtgtcgtttttacctcttattgtgactgtttactgtttcaaagaaacagatgagttttattaaaaataaaactcattaagctgaaagctttaaacaacatgagcgattttttaagaaaaattgcgaatggacaagcaaaaaaagagtggggttcttaaggggcaacaccccttatataagggttgttaagggagtatctcttaaatattctcattaaaccataatataacaaccaccccaaaacccaatcaggtcgggtcggcggtagtggtcgtttcaaaaatctcggacagagttttttagaaaatccaaccacatcataaattttttcccaaataatacacaaactgcacaacctacccacaaactaagtcgggtcggggtagcttttctgacagtaaaactcgggcagagttttacgcagtcatcgaaaagcgttataaggcacttcgccgagaagtgtcgtttttacctcttattgtgactgtttactgtttcaaagaaacagatgagttttattaaaaataaaactcattaagctgaaagctttaaacaacatgagcgattttttaagaaaaattgcgaatggacaagcaaaaaaagagtggggttcttaaggggcaacgccccttatataagggttgttaagggagtatcccttaaatttacccctttaaatttttaagatatttcttcaaattcccctctgctccgttttccttaggctcgtagtaaactcttccccttatttcttcaggcagataatcctgctttacataatcgtttgggaaatcgtgaggatatttgtacccaacaccaataccaaattccttttcccccttataatttgcatttcttatatgaagagggacttcatagttaggctcgttttctatatcagctaaagccttgtttattgcaaggtatgaagcattgctctttggtgaagaggcaagataagttacacagtgagcaaggtttatcctagcctcaggcatcccaataacttcaacagccttaaaggtacttacggcaagttccaaagcttttatatttgcgtttcctatatcttcagaggcaaaaataatcattcttcttgctataaattttggatcttctcccgcatatatcatcttagctaggtaataaatcgctgcgtccggatcagaacctctcatgctttttatgaatgcacttattgtgtcgtagtgttcgttgtcccctttgtcgtatgtaacttttttcttttgcatacattctattatcacatcaaggtctatgtttattacccctttttcgtcctttggagttgtaagataagcaagctccaaagcattaagagaaacccttgcatctccgctgcacatagtgcataaatagtccatagcctcattcgttatgtttatttcataatttccaagtcctctttctttgtttgaaagtgcgttttctataatctttcttacatcgtccttgtcaatcttcttaagcttaaataaagtagaacgtgaaatcaaaggagaatttatttcaaagaaaggattttccgttgtagcaccaattagaataatcgttccgtcctcaacgcttggaagaagtgcatcttgttgtgatttgttaaaacgatgtatctcgtctataaaaagaatgctctttctcttctccagcccaagattattctttgccttttcgattatctcccttacatcctttactccgcaggttacagcattaagagaataaaaataagaactggtcttgcttgcgattatcttcgcaagggtggttttaccacaccccgcaggaccaaagagtattatggaacttattctgtcagcttcaatcattctgttcaatagcttaccctttgatacaatatgctcctgaccgtaaaactcctctaaactctcaggtctcattctaaccgctaaaggagccttgctttttacctgttcttcccttatatcatcaaaaaaattaccttgcattttttctccttattacattaaatttataatactaaatatcttttacaattctaccacaaaataatatcaataaccatcgaacataaaacaatatatttaaaatataatgtaatattaaatcataaactcccctgtctgtttgttctaaattctcttttgtaggtaattttttttgctccataaaatcagcttttaaaacttctctatctaaagcatttgtataagggtttctcattacttcaatccttacaacattcccatcttcatcaaatatatatctttcacttcctgcgttataaacagtgttttcattgtttttacctctgttttgtggtatactttgattataagaagcaagatttccaaaagacgtttcggacgtgtactgagggttgttttcagcattagagtagttggtcaattgcttcttatttttatatttataagcagtatcaactctaagaagtttattttttgtatcaggtacggcttcaactacttcataatatccgtttattctttttgtcaatattatagaatcagctctgcttttatctttattaaaataccttacacttttcttatctccaagttttatgctgtcataattatctataacataacctattcttgcaatatcatttatatctgacatactttcattagcttcaccattctcaccgtgtctgtcccagatatgttctactgctatactgtcaatactattcttataccccgttatatcaagccccgtaagcttttccacatcctctataagctcattcgatacatttcctatattatgatagggttttacttttttccccttatttatgttttcaatgtatcgtataagcccttcatctacagcattttcataatctttctttataacctttatatcatcatcactaatactttcactgtctgctcttacaatctcattttgttcatctatctcttcattgctttcttttatatcttgtgatatattttgattagaagatgtagagttaaaaccgaaagtcgtttcggacgtgttctcagggcttttttgagtattgagaagtcggctatttacatcttcttttttattaatatcttcaccccttaaagctcttacttcttcctctaatgcttttatttgtttgtcaaacttctcttgttgtttgtcaaatttatcttgcatttgctttaaaagtttttctgtgtctgtttctataacattttcttcttttaatgaaaattttaggtccttatctgaataagattgattattgcctgtattgtaatcaaatatgttgatattatcaacaagatctgatatacttatatcaggtgtaaccacataggaattactattcattgtgtttttcataatgtttggtgaggtggttacaccttttatttttaaaacttcactatctacaatatataatacatcagaatttggtttttctcttgcaacaattctaacacgataatcttgattattcattcttatcggagcaacaaaatgatgaaattccattgatgccttatttatatttttttgcttttgatttttaaaactatctatataaaccgcattttcaaacaatttcggtaaatataaacttgcatttaaattttcaatataatgcaaatcccatggatgaaacttggatgaaaatgtaggatgtaagatttttccgatggtttgactgttaatatcggctttatatcccgttgctttattttcatacgttcctctttgaatatttttgaccctgttttgtaaattttttaaattcctattgtcatttttccttacgtttatataagaagtatggttaatatacggtattttatcagcagaatttatatttttgttctttaaacttaattttacatcatcacccgttttatatttcctgttttcttcccttgcaagttctctgtacactttctcaaacaatgtttcggcattgttaatatcagaatataaaacatcatttttagttattattgattttattctttttataaaatctcttattgtttcaaataaagttttattattacccgcaagtcttgttagcattgcttcatcattttcaaatattcttcttgctataaaatctgcgacaacttcttcttgtatatcttgtgatgtataatcctatttcgcctttttctattgcatttagatatctactttcaatctctgcttttcttgcttgatattttgaatttttatttatttcttctaaagaaaaaacttctaattcattatataatttttctgattttgaacgaatatagtgtactaattcatgtttaaatgttgtaaattcagcatttttattatttctgcttaaatatatcactccgtctttaacatatccatctatattctctgatacattatcatttatatattcaacttttgcacctattttatttgcaattttattgaatgtttcaagattattttgttgcctatttaaaggtaaaatattattttgaacattattatttaaaaatttcctataatcagtaacaacaattctttgttcgtttgtatcaagtgtaagtcctaaagtataagtatcattcccaacttgttttataatatttatcccaggaccatttttttccataacatcaaaaatacaaaatctatttttaatatttgcaatatgagtatattgtaataattcaaaatactttatgatataataagaaaaaaaggagaaaaacaatggacgcactaattgtagtagatatgagcaatgactttattgacgacaaaggaagcttaacagcaggaaaacccgcacaggacataacacctaaagttttagataaagtaaaagaatacgataaagaaggaaaaataatcgtttttgcaatggacgcacacgaagaaaatgataagcacttcaacctatggccaaaacataacgtaaaaggaacatggggacaagagctttatggtagcttaaacgactggtataaagaaaataaaaataaagataacgtaatatggcttgataaaagcgagtacgatgccttttataaaactgacttagccgaaatgctaaaaaataatggagtagatgaagtgttagtatgtggtgtatgtaccgacatttgcgtatttaatacggtttacggagcatataaagaaggctttaaaacaaaagtagataaaaacttgtgtgccacatttacggataacggcgaaactttcataaaccaaatgaacgcaatttataaaacggaaattctataaaaaaaggagcttatatgctcccttttttattatattcacaatataaaaacatataccccactcactacatttcaccaccatgaccaccacacttacaaatctgtcggggtagcggtagtggtcgtttcaaaaatctcgggtagagatttttagaaaatccgaccacgttataagccttcacggcgtatgagtgaaagcattttatccagtattttttgcttcggaaaaatactggtcgctctttagagcgaaaccctaaaaccccacgcccagtggcgcccttttattcgacttttttaggcgagtaaaaaagtcgtggggtttataaggggcaaagccccttgatttcgggttgttaagggcagacagcccttaaatatggggttcttaaggggtatccccttaatccccatttccataataattaaccccaaatactccaattataattacaatagcaccgataacctgcattaagctaaaaggttccgccataacaaatatacctataagaaccgaaacaacagtagttaaatttgaaaaggcagaagctgatgctatatcaaggtgagatactgtataagtattgccaaaaaatcctataacagaagcaatacatccaagatacatcatacacagtaaaactttagtatttgaaaaagcgagcatatatccgctaaaaccttgatttgtaatcaaagatataattccaaaggatatacacgcaaaccacatcatgaaaaaggttatctccataacggaaaattcctttgataatttccttgctaaaataccgtacatacttgaagcaaaaaccgctccaaacaaaaataaaaatcccgcaaaattaaatcccacatcagaaacataagacccaaacacaaccgatatggctccaagaacggaaagaactacaaaagcccactgcttaatagtaggcttttcttttaaaataaatattgcaagaacacacataacaacgggaatagtggcaatcatcgttcccgaaagtgccgaatttgtaaggcttacaccgtaagtctcacatataaaatacattaaaggctgacatatgcaaagaggaataagaagttttatgtttttttccttatagtcaagcttaaatacttttagaaaataaagtatagtcataaataaggctgcaaacaaaaatcttaccccgggtaaatcaagaggctttaaaacggttaaagcctctcttgtaaaagcaaatgttgtgccaaaaacaaaggaatataatacccctgttatgtatgccgttactttcttgttttttaacatattctatacgaaatatgcaaaactttccacgttcttttcttctgattttataacttcgatttcacggaatttaagtcttaaaagttcgtacattatgtcaaggaaacatatttctgcattgtagtgtccaacacctattaatacaatgccgttatcaacgtagttttgcatttcatgatattttgtatcagatgtaataaatactttggcatttttttctttaactttatctattaagtcattaccaccaccggtacataaagcaactttacttaatataccaagagtgttgtaattgtttgttactcttaaaacatttgtattgtaagctttttttacttttttaagtaaaccgtcaatgttcataggtgttcttgaatcaagaagaccaacagcaccaagaccaaataggtttgtatcgtcttcgcatttatcgcttacaactctttcaagtggtttaatatcgcttaaaccaagctttttagccataaacatatttagcccgattgtagacacatccataggagtatgagcagaatatacgttgatgttgtttttaataagtttgaatatcatatcccctttaatgcttgattgttcaatgttcattgttttactaaagaataaaggatgatgagatattatcatatcacaatgctctcttattgcttcgtctattacttcgtttgtaatatcaagagcaagcaaaattctccttacctgagcttgtctgtttccaagttgaaatccggaattatcccattcgtactgaaaactttcatttgcgaatacgttaatgtactttattatatcttttactttcataattttctcttaccctttccagcaaagttatataatctttcgctttattcaatgcttcttttgcattttcagtatttttatttttacaattttcaacgattttcttatttacctttattttgtaatttagaaaatcaagaaaattttcattccctttttcatatagtttataacctaaatcaaagaacacatcttcatatttttcatcatcttttttagatataacctttaaaacattataaaaatgatgtctgtctcttatcaaatcttcatcaacaatggtaaaagaattatcatataaatatttccttaccatatcaacactgttcataggctgaagaataatatttttaaaaccttttgtcttttctaaatcatcatttagtatatcgataataagttctccgcccattccgcatatacaaagggtttcaatattatttgtatctatatttttcatgccgtcgcttaaaacaaaagtaacatctttttcttctttaaacatcttagaaaagttttcttttgcatttaaaagaggtccttcgtttacgtcgcttataacggctctttttatcatattatttttaaataattgtatgggtaaatatccatgatcagaaccaacatcaagaaccgattcgcttttcccaaccatgtcatataccgcttttaatcttatatccaaatttaccataatttctaccttatataacaaaataagtataacataaaattttctttttttaaacaaaaatattatttaagggtgttacccctaacacctttaagggattctcccttaacaaccctatcttaaggggctttgccccttataaaccccactctttttttgcttgtccattcgcaatttttcttaaaaaatcgctcatgttgtttaaagctttcagcttaatgagttttattaaaaataaaactcatctgtttctttgaaacagtaaacagtcacaataagaggtaaaaaggacacttctcggcgaagtgccttataacgcttttcaatgtcacgcaaaatgctgcccgcattttacggacagaaaagctgccgccaccctatcgtttataggttttaatgctaaaattaaaacagcataacaaatataaattaccatttaaaatctcatctatatgatattttaaatataaaaaattaccgttaaaaataaatttattaagtagatttacatataatatcttttaatgtatttcgtccttaacaacccgatattaaggggctttgccccttataaacccaacgacttttttactcgcctaaaaaagtcgaataaaagggcgccactgggcgtggcattttagggtttcgctctaaagagcgaccagtatttttccgaagaaaaaaataccggacaaaattctttcactcaaacgccgtgatggcttataacgcttttcgatgcctacgtaaaactctacccgagttttactgtcagaaaagctacccagccctttattagctttaatgtttggagtggaacatcataataaatataagttatcttttaatataaattttatacaacattgctaaccaagttttacaaagcagtgctacctctactccgccgtttatcaatcttaatggtaggagtagaacatcataataaatgtaagttatcattttaaaattttttatataggttttataaaacattgatacttgtattttacaaaaataaaatacccatatcctatcatttattagttttaatgcttagaagaaaaacaatataattaaataatagataagtgataacattaaatttattctttataaacttacatttaaaataatcaaatagaaaactaaattaacaataaatctttcaaaagtttttacaaataaaaaaagactctaaagagtctttatgaaaataatatttttagcaaaaaaaaaatggctccccaggtaggacttgaacctacgacctttcggttaacagccgactgctccaccgattgagctactgaggaacgcttagtactttatatattatacactttatttagaaaatgtcaacaaaaaaatgcaattatattaaaaatcttctcttttaaactttgctctgaaataaacatagatcgttttcgcagtcattaaataaaatatatattaaaaaaggagcattacgaaaatactccttttgctgcaatattaagataggttatgcccaaacatcgtttttttcattatttataaataagactttttcatatttaacagcttttctccaagtcataattcctgtaattggagcaattaatgcaatccaaagaagaattattgtattacataatatcagcttcaatggaagcgttattatcccaccaaagattatcaaactactaaaaaatctatctaaaaactttccttgataattccaataagcatagtgccaaaatctccacgaaagagcaatccataataaagtaatcccaatctcaaagtatggaatatatgctcctaaaaaagcaataggaaaaaagtgtttttcaagaaaatatatcatcggtggcataaataaaaataacaacacacaacctacgatcttttttattataaattgtttcctataattttcacttaaatgctcctttattgaagtattaacttctataaatttttgtttccaaactttcaaaaattccaatcattccaactcctttataatatttttatatctacagctgcaatagtagtagtctatctatatcttcatacgatacctattcttttcactgccttgtatccgcacgaataacctacatcatacatagcacaaataatgagcattggtaactataaaagagctaaactccatattatgtaatctacaataacatactgtgtaagtcttagtcctatattttgtgtcatcatgtggtgtccagttatgcgaatgtgatgattttaaagaagatgtaccagaagaaatttctccgaagtttagcttgcttgatgctttcttactgcaatgcttcttcttttacgatctattcaaaagaagcaagtcataaacaaggaactaatagcatcataatcgtcaatacaattttaacgttttttataaaattagtttccttttttctctattttatattttttactacggtctgttatatgaacatttgtttaaattttcgcttatgtgaagatttttttgcatttagtagatattttataatgtacaacaaaatctccttagaacgaacattttacccgtttctttaattttattataccacaaaaatttttaatttttttttatttttataacaagagtaaaagtaagaataagaatatatggttaggcatttatccttttatttttataataaacatctattcttacatcaatttcctaacattaaatcaattaaatcattgaaatatgaagaaaaacagcctaaaaaatcaagttagaaaaaatttttctaacttgattataaaatccagcattatattaaaaatatttcaaataaaattttatataaagatgtatcccctttaaataaaggttaacatgtgtttatttattatatgacatataaaaaattatattcttctttcttaaattttttatataggttctataaaatgttactacataaagtaaaacaaaatacctctatcctataacttattagttttaatgttagaataaaaataatagataaaaggtaacattaaatttcttcttgataaactgtcctttaaaataatcaaatagaaacttaaattaacaataagtctacaaacaaaaaaaagacttatacaaagtctttataaaaataatatttttggcaaaaaaaaatggctccccaggtaggacttgaacctacgacctttcggttaacagccgactgctccaccgattgagctactgaggaacgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgacctttcggttaacagccgactgctccaccgattgagctactgaggaacgcttgatactttatctattatacacttaatttttaatatgtcaactacttttttcatttttttccatgaaaatgttatctatgtatttattcaaatttagtaaaatataaatacacttttaacattttcataactatcaaatattaaataaataacaatttaaactaataaaattatttattattcctcttgttcttccctttttattgtgcttattatttcgctttttgatagcttttcataaaacaaaggtcttcttattattatcattatgcaggcaaagaagaaataaaagaaatatactccgcttaaaatggcatttaaaaatacaaaagcatctgtatttataaaccaattatttaaaatttcatttatttcataaggaagcagtaacaatacgaaaaacaaagaaaaataccttataaaatattgataaattcttatatcatcttttcccactgccacaatcctaagtttcattaaggcttttccaatgcttctgccctttaagaatacgcataaaacaaagaaatacataaacacggaaagagagaatatataataatcatctatgccataatcaatgtttatatgccttacaatataatataatccccatataaaaggcatatcaataataaaagctataagttttcttaaaaaagaaaccttaattcctcttttgtaactttcatcatccatctcttccctatccggcagaaccttataaaatggttttataacgaagtaaccaataacacccccaagggtatttatgaataaatcatcaacatcaaaaagcctgtaacttcttggataaaagaaataaagcccgcttaactgtgtaagctcaaaaaacaatgataataaaaatgaaaataaaattgtcttttttaagctgaatttaaaataatatcttaaatacattccaaaaggcactgtcataagcagattaaataaaacctgtaaaaaagctttattatttacaatacaggtaatgggactactataacttaaagacattttatggtactgacttataatatcctttataaaattaaaaggaactaactgagccgatcttgttgtgagagatgccacctcggaaaacgacggtaaaggcagaataacaagaaaataagccgtcattaaatataatataaaagaatatattataactatcctgacagaccaaagagaaccatatttgttgtaattatatattatgtaaggaagagtaaataaaagagcaatcaaaggaaatgcaaaaatagactcttttattatatccaaatatcctcccatatttcctccttttattataagataattacatattataacaacaaaacaattacttttcaaaatattatagaatattaaataataaaatctaaaaaaaatacaacaataaaacattcaaaacataaattaatcctaaagaaatataccaaaaaaatttatataaaaaccaatagaactaattaacaataaaaaaagagcataagctcttttttaatcagataaaaaattcttttttaacatatcatctgcttcatcccagaaagcttttgtgtcatatttagtatctctttccctgacttcataggaatcttcattttcaatatttactattgtgtcattatctttttcatctaaaatatcttcactaagttttgtatcctcatttatttcttcttttacatcatctataatctcgcttgtttcagcttctgcttcttcgtattcaaattcattttctaaagaaacttcttctttaacaaaactttcatcatctttgttttttttgtcttttttatcctttttatctttcttaccaaaaagatgttttttcttttcttctttttcttccttatcttctttttcttctcttaaagcttttctttcttctcttctttttaatctttcttctctgtcttccatgctttcaaggaagaatttagaatctttttcaacctcaatataatcttcagtgaattttgagaatacatcaagtccgttataaactatgttatcttcttttaaaacttcatcaatatcataattatccaaacctaaaaaggctgcattcttacttcttagataaattaaatccttatctttcttttcatcaaaattaatatttgataacttatcaaataattctttagcttttgaagtatcaccttttttaatataatacataaccatatgagaacaaataaccaaatatgcttttgtatcatctttaaatcttgaagttttttctactgcaatggtatcaaaatgagaatataagtagttaatatatttttcaatacccgaatttaatcttgtaattttcatatcaagatattctcttaatatataatcaacgattttaatatcatctcttgaaacatcatcaatggttaattctttatttaaataatctgatatgatttttaaaagataagttctttttacacctttgtttctttcattataacttccatatatcaaaagtttacaagctaaaagataatcatattgttcatctgttagaacgtgttttattatatgttttccttcttcgtcaacttcacctgtatctattttatcatttggaacaccaaggcaaatttccccttctagaagagtaaataaaatttgagttgatgaaaacaaaatcaaaaagataagtgcaacatcaaagaagaataaaattacttctgagaaaacatatacgtagatgaaatatactgcaagacaagaaagtacaagaagtataaaactacccgctatgctttcaaatacggtgaaagtaaaatctgccttaagcttatcaaactcttccctgttttgaggaagattaaatttaggaacaatttcacctattgaaaagtaatttttattatgcactcttccaaaaatcttcttatcgggatctttaaataaaatatagaaaggatccatataaataaaagatgtgtcataaccttttttatcatataaaatactgtatgatttatatctaaagaacaatgaaagataatacattaaaacgactattacagggcataaaggaagcagccataagctgtgacccattgcaaaagaaaccaacgtacttccgcttataagcccgaatacgacaatgactagccatattatttttaaatttttctttgaactttctctcataggtcaatcctcaaatttaattatttatttttcttaccaaatgtaagtttattttcattaccgtttattattcttactatattctttctatgttgatatatgcttaaaacacataaaatacaagctaaaattatataacaaatatcaactttaaatactataaaaaatactgcactaagtgttaaagcagttaaagaaccgactgaaaccattctcgttaaaagcgcaagtatcacaccaataagtattgccaaaagtgcaagtttataatcaaccataacaagaattcccgcacttgcagaaactccctttcctcctctgaatcccataaatataggccagttatgaccggcaacacataaaagagaacagattaaaattacaagagagctttgattaaacatataacataaaagtactgttacaagcccctttaaaaagtcaattacaaaaaccaacgcccctgagaaaaatccatatgttctaagtgcgttagtagctccggcattaccgctgccataagtccttatatcttctttttttacacttttggaaaatatgtaagcaccatttatacatcctaataaataagatactatcattaaaataaaacttaaaaaagtaaattgtataaccatgaaaactcccataacataaattttacttttagtattatagcatattaatatataaataaaagtaggttaaatgaaattttaataattatttaacgtaaattaattttcttaaaatatgtagttattaaaaactaaacagatacttttttcaaataaatttattttcccttttagtaaataaatttattaatcatttacacgatattatataaaaatataaaattatatgtaatattttactatcttttattcacacaatatacaatttatgataaatatattacataacataacctaatataaaatttatataaaatctgtatactatattgttgttttcaatttaaacaatgatttaatatactgcttataaaattatttaactaaatttttatatatttattattactaaaaaatcactacttataattttaagcttaaattattcaaaatattactaaaataaaaacttacttaagcacaaaaggaattttattcttagcttctatttcatcttttgtaacactgcattcataacaaagaacatttactccattatcccttgcttgttttaaagctttgataaaatctttatgcactggatttggggtaaaatactttgagcctgcaaactgaattataaagcagatataagcttcatagccttctttttttgcttctataagttcatatacatgtttaatccctctcgttgtgggtgcatcgggaaacatcgctacaccatcttcttccaatgttaccccttttacttccacatacccctttttattctcactttccacataaaaatcaaaccttgaatttttatatttctgctcgcctttaataaaagttacctcccccatttcatcaagggtaataaccttatttaaaactccctctttaaataccttgtttggcatttgactgtccatgttaaaaagcacatcatttttatatacgcttattaaatcatactttgtctttctggctttactgtctatatattcaagataaacatcggcattatcagtaagcaactccctgcatcttcccgtattttttacatgtactttttctatcttatcatcaatcaaacaatttgctataaacctgtttggtctatctataaattttcctttaactatattcttatatttcatactacctcttttcaataaaatattatatcaaaccaccttgaaaaaagggtgtttttaatttaaaattaattttatggaaaattataaatttataaataacaacaaatgtgaatttttcccctgccataaaacagaagataaagataattttaactgtcttttctgctattgtcctttgtatttaatggaagaaaaatgtatgggaaatttcacttatacaaaaaacggaataaaggattgctcaaactgcctactgcctcataaaaaggaaaactacgattatattaataacaaattaatggaatttacaaatatgaaaaaggaagaaaaattaaaaaacattaaactaattattactgaccttgaccatactttattaaaagatgaattcagtatcgatgaaaattatgtaagtctttttaatgagttaaaggatatgggctatataactgcattcgcaaccgcaagaggcttttatcaagcgtttaacttcgcttataaattaaaaccggattatataatatgcgataacggagcaagcctagtaaaatacgactacgaaaaccaaaaaagacatatcttaaaggaaatattaatcgaagaagaaaccaaaaaagacgtattaaacacactaaaggataatgatactttaatttatttaatcgaatcaggagaggatttatacattacaaaaagcaaatataatcctgaaattgtaaataaaaatataaacttcttctcgccaatagaaaatatagtagagggttttaaacttcacgtaatagataaattaagggatatgccttttgatattcccctaaccagagtttgcacatttgattttgtcggtgataaaaatacccatgatacactaaaaagacttggagaagctcatgataaattaaactacacaaaatcatttacaacaacctttgagtttggtccctcaacaaaaggaaacgcacttttatttttaaaagactacttaaaaatagctaaagaaaacattatttcttttggagacagcataacagacgtatctatgtttgaaaattcaggtgtatcggtctgtgtggataatgcttcagatgaggtaaaaaaacacgctatgtatataaccgacagtgtatttgataatggcgtagaaaactttataagagagaatttattaaatgaaaaataataacagctataaaaattttagtgaatactatgataattatatcgctcttgcagactatgaaatatgggcagattatataaaggacctttcaaccataaataatccaaacactattttagatattggatgtggaagcggatatatgatgctttttttaagcgatattttaaatggtgatttttacggaatagatataagcggtgaaatgcttgtaaaagcaaacgaaaatgcttactatgaagaaaaagacttccgttttatgaaagcagatatgaaagactttgtttcagacatcagctttgattttatttacagcgtctgcgacagcataaattatcttcaaagcgaaaatgatttgttaaagacctttaaaaacataaagaaatatctaaataaaggcggtagttttacttttgatataataagcgaatattataaaccggaaaatgaaattttagaaaacgaaggtttaacctttgatgtaagaagaagtaaaaaagataactggttaaatactacaattataatatcaaacactaaagaaagactatgtaaggtagaacataaacaaaggattttctcagtaaatacaataaatgaagccctaaaagaagcaggctttgacaatgtatttttctacgacttccttacaaaagacaaaccaaataaacaaagcgaaaaaattcaagcagtggcatattaaccactgctttttatttgtatttgtttagtaattttttataaatatataccccaagaacataatttaaaataattaaaacaatcaagtaaataataaaggctgttatgcttattgtaatttccatcatatataaacaagcaaagacaaaagcactgatacaaagtataattaaatttattatataagcatatcttccgcttttatttctaaggctttttttaattcgtcatgcaattctattctttcattttcaagtttctttaaatatttttccttgtttttatcattactatagtaaaaatacctaaatatgctaattacaccgttaaacaaaaagcctccccaagaccaataaagatactccccagtctgctttctttaaataccgcaagcattataaacaaaattccaatcaaaacaaatatagcaccataaataaaattactctttttcatttttcataacctcatatataaaaatttcttctatagtcttattgaaaaaacgagatatctcaaaagcaagttccaaagagggattatacttcccgttttcaatagcacttatagtctgccttgatacttttaattcctttgcaaaactctcctgattaagtctcatttcctttctaaacttttcaacgttattcttcaacttcaccctcctatgtaaaggttcctttacatgtattatactctaaacaacaattttgtcaaggttcctttacaaaacaaaaaaacaccccataaaacaaggcatttcaaatctaaatattaatatttatatcacttccataactccacactatcccaaagcctagcataaaagaatttaaagaaataaaaaaacaccccacatcaaatccatacggggtaagggtagcaacaattcccgaaaaaacgggtagttttttcgaggaaatcttgttgcgttaaaggctccacgcccagtggcgcccttttatccaaatatttgggcgagcaaatatttggtcgggttgttaagggttgaaaacccttaaatatggggtttaaggggcaacgcccctttataaaaattctttaataaccctgcttacttcctttgcatttgtacatattgaaggatgttcaccttcacttactatcactaccttacaatcccttacctgactttttataaacttatattcatcgataaaatttgaacctatcatactgtcttctttactgcctataagaagcaaaggattttcaatctcacttattggcttacaaaacaaatctatgttttcatctgccatttttaataaacactgtgtatccaaatcgacaactttttcccagtcgtctccgttacaccactgataaaaccctcttgccatttcatcttgtttggcaaaatttctttcttccaataaatctttagaaaaagaagagcgaagtttcaatccgtcaaaactatcacatactattttgtctattttaaaaggtgcttgcattgcacagttaagtgctgcatacgctcccccgcttgttccaacaaggcttactttcctggtattaagataatcaataagtgcaattaattgttctgactgatatagccaaagattatctttaaacttttcaactctttcagactttccacatcctaaaaaatccattaaaataactttaaagtcatcttgataaaaaggtaaaatatactcaaacattttagaggaagcagtattcccatgtaagaaaataacaggcttaccttctcctataactttataataaatattcttgtttttatatttaaaaaatgacattttcttgcctcccaatttatttttattatttttcaaatcggcaaggcacacaccctgccattatttagtccaaattcccataataataacctcctttttcttgattatatcacccttaatattattttaacaacaaaaaaacaccccataaaacaaggcatttcaaatctaaatataaatattacttccataactccacactatcccaaagcctagcataaaagaatttaaagaaataaaaaaaacaacccacaatcaaatccatgtgaggtcggggtagcactcgttcactgttaaattaggtattttccccataaaatccaattacattaaaatcttcaagatatctacataaaaatctttccccaaaatttaaaaaaaacaaaaaaacaccccaccccacatcaaaatacggggtaagggtagcactcgttcataggaaaatcgggtagattttccatgaaatccgagtgcgtccaaggcacttcgccgagaagtgtcctttttacctctttttttggacaagcaaaaaaagagtggggattttaaggggcaacgccccttaagatagggttgttaagggttgaaaacccttaaatatggggtttaaggggtaacaccccttaagatagggttgttaagggagtatcccttaatggggtttaaggggcaacgcccctttatcttattatttattagcactaacataaataggataaatatcctcttctgttaaaggaataagttttccaacttttgtacctttaacatagaaacatctgtcagtaagttctcttaaaccttcttcatcttgaataccgattccaagttctgtaaagtttgtaggcatgtttatagaacggaagaattctgctgtcgcttcaatacctttatcagcaagttcttcttttgttccttcagtaataccccaaacattctttgcatatcttgcaaatctgtcaatgtctttgtgttttacataatttgcccagtgaggccacattgtagaaagtgaagcaccatgagcaacatcaaatttagcacttagagaatgacctagtctgtgagttgcaaagtccataggagcaccaagaccagtaagtccgttgtgtgataatgaacctgcccacataatttcgctcattgcatgatagtcttctttattttttgcagcaactttaccgtttttaataactgttctaagaagtgcttctgcgatttcgtctgttaaatcgttttgacattcacttaaatctgtaaaatatctgtccattgtatgcatcataatatcaactataccacatccaacttgataatcaggaagtgtaaatgtaagttcagggttcatgattgcaaattttggtctgttaaagtctgttgaaagacctctttttactcctgtttcttcatttgttaaaacagctgaattactcatttcgctgcctgctgctgaaatagttaaaataacacctacaggaagtgatttttcaacttttatctttccttcccagaaatcccaaatatcaacatcagggtttgcaacaccgtgtgcaatagcttttccggtatcaataacgcttccgcctcctactgctaggataaaatcagcaccaaaagcctttgcgtcttcaacaccttctcttgcaagagataatcttgggtttggtttaactccaccaatcattttatattcgatgttttctgctttcaaagcttcttctactctatcaagaagtccgcttctttttacgcttcccccaccatatacaatataagctttctttgctccgtcttttttcatttccattccaacttctgcttctcttcctttaccgaagattacttttgttggtgtgtagtaatcgaatttttgcattttgctcctccgtttattatattatattttattaaagccaaggtcttttgtctttggtgtaacctttcatgttccagtattcattgtcgactttatttaagcctccctttttctgtaacatccttacaccgtaaaaccaaagtttcgtttttattccaggctttgttttaccaatgttttttaatatcttccttgccgttttatcggtctttttgtctattttttcttttacctttttacttactccattccaagttacgctgtatacatttattccaagagtatatatttttgctactccccaaaagaataaactgtcttttattccctttatagctttctttgttcccattcccgcagcggttgaaatacaaacagcctgctttttaaacataatagcttcgggtctatgaacaatccacctgtaaccaaaatggtctaaaaatcctttaagctgaccgctcatatggaatacataagtaggagtagtaaatataagcacatcgcactttttcattatctcatcaatgggatgaataagttcatagtgtgggcataacttctcgcttttcataaaacatgaattacaccccatacagtatttatcaaaatccttaggtaagaatatctcaaaaatatcctcttcacttgtaagttttaaagccaaaatctttccggtattgtaacttgaacctttgtgattttgaccgttaattaaagctactttcaaatcttcctccaaacttaaagccttttacctactacgcagtaccagtcccccatattgtttacttcaagtatttcaaaatcattttctttgtagctttctataactgtatcaactgtttcttttattataccgcttgaaataaatataccgccttttttaagtatcctcttagtatcgggagtaagtcttcttattatatgggcaaatatatttgcaactataacatcagcctgaacgtctaccttttcagctaaatctcctataaacacatcaaacttatcagaaacagagtttatctttgaaaggtatgaagatgtctctatgcacattgggtcgatgtcaacccctgtcacgtgcttacagccaagttttgcggcagcaatggaaagtataccgcttccgcatcctacatctattacttcgtctccctctttcatgtaatcttcaagccctattaaacacatctttgtggtttcatgacttcccgttccaaaacttgccccagggtcgatttcaagaattattctgttttctttattgtcgcattcttcccatgtaggttttataagtagtttcttacctacattaaatggcttaaagtatttcttccagttgttcgcccagtcctcttctttaatgtcgttaaaagtcatgttaagactgccaaatatatcttcactatctgacgcctttaacctgtttaacatattctttatttcttctattttttctgcctgattttcatcttcaagaatatataccttaacgtttgtttcgatatttttcttctttaaatcttcgtcaacaaggtcccatgtttccctgttatcttccaaaaattcttcaaattctttcttatcttctattaaaaaactgtccattcccatatcggacaaagacgatataagaaggtctattccctctgtcttcgtatatatgctgatttcgttataattcatattttcttttctcctttgtataaaattatataataaaaacagaacacgttcaataatcgtaaccgatattaaatataaaaattaatgaccgttttatttttcattaaaataaaaatatatataaattgatgtaaaatctttataaattaataagtttttaattgaattggtacttttattaattataatttaaaatataaattgaagaaagggcatacaaacatgaaagaaattaaatttaaagcagatatcaattttacaaaattcaaaaaaattttcaaggcacaaaacaaatcatattttaaaaaacttggaatattctgcagcattttttttattcctttgtcaataatttccgcttatatattcataacagaaacaacaatgcagttttttctgtattttattcttttccttgttctcgcagcttacggagcaactcttatatttaacccttgtataatttttgtaacaagacgcaatatcgtaaaacaatggtttcgcctccatggttcaaaaaatttgaatgaaaattataaaaattacatcacagtatatgaaataactctatcacaatatggcgtaaaggaaatgttttcaaacgaaaatttaataaaattaccatggtttatgtttaaaaacaaatacgttacaattgatgaaggaattatatttccttatgatgacggtaaaaacagttctttggcatataacttactcggaataaattatcttttaagagaagaaaacacaggcgaaacattgtttattccaaaggaaatattaaatcaatatccgaacttaacgaatgaaatttcaaaagcaatcgacaaatcgaaaaaaacatatttaaaaacaaacaaaaacgaagatgaaataaacgaattaaaaaaatggctcaaacaataaaaaccgattaaggataaaatcatgaaagaattaatcaatataatgatagaaaaagatatgggcgaactgaacataatggtatttgttccatttataatattgattattttgggataatgattttctttaaaatttatttaacaaaggaaaaatcatttacaaacaattccgcaaattttctaaaatatcttttccccatgacaataatattattcgtattcgcatttttcatgatatcaaacgtaagtttgtttgaaaaagaaaaaaactggtatattataaatttacctataacaaacaaatatgaaacaataaactcgtccggatcgggaacgagaaagacaatatactacgtaacaacaaacgaaaacatcaacatatccgtcacaaaagatttatatgataagctggaaataggtgaaaacgtatatgttctaaaagacaacgaaaacaattccttaaaaatttattcccaaaaggaatatatatacaaaggaacacgcataaaacaaaaaaaacagcttaaagctgttttaatcttagtggtgccgaagaccggagtcgaaccggtacgatcttataaggatcgcaggattttaagtcctgtgcgtctgccaatttcgccacttcggcataatggagcgaaagacgagattcgaactcgcgaccctcgccttggcaaggcgatgctctaccactgagccactttcgcataaaatggtggtcgcaatagggctcgaacctatgaccccctgcttgtaaggcaggtgctctcccagctgagctatgcgaccaagcaaaatatagtataatgtaaattgacttttttgtcaacaattttttactttttttttaatttttttatttaataaatatttgtattgattttattgaaaaaatatatataatattctaaaagaagtaatacttctttttttaatcctaaaacttgtatatccatttaaccgtctacccgtgatatacaagcaggcaccttacggtgtcttttttatttccgattgacaatacaatattaaaatgttatattatgtgaaaaaaggaggataatgaaagaatgattattttttcttgctaatatttatcaatatgcataaaacaaattttaagcgttgtttttatgcaaaagcaagaaaataattctttcattcagtccttgtcgtattacaaaacagaccgaagaatattttcttgcggtctgtttttttaaggaggtatgaaaatgtcaacaattaaaatacaaaatttaaccttctcccacgaaggaagttatgaaaacatattcgaaaacctttcgataaatcttgatacgtcttggaaactcggacttattgcgagaaacggaagaggcaaaacaacatttttaaaacttctgatgaacgaatacgattataaaggctcgataagcaaaaatatcgaatttgaatatttcccgttcgaaattaaaaataaaaacagaatgtccatcgaaataatagaagacattaacccaaactttgaatattgggaattatcaaaagagctgaatatgctttctgcaaaagatgaaataatttataaaaactttaacgaattaagtaaaggagaacaggcaaaattaatgcttgccgttctttttacaaagccaaacaattttttgcttatagacgaacctacaaatcatttggacgtttacgggcgggaaacacttattaaatatttaaataaaaagaaaggatatattttagtaagccatgaccgtaacttattaaaccaagcaacagaccatattctttctataaacaagaataaaattgatttacaaaaaggtaatttcgattcgtatatgaaaaataaagaaagagaagacagttttgaaatatccaaaaacgaaaaattaaaaaaggaaatatcacatatggaaatggcagcaaaacagacttcttcttgggcaaacaaagttgaaaaaacaaaatacaacacaaaaaacatatccggacttaaagtagacagaggatacatagggcataaatccgctaaaatgatgaaaacctcaaaatcgataaataaaagaataaacaaaaaagctgaagaaaaaaaatcacttttaaaaaacattgaacatagcgaagacttaaaaatatcccctatctattttcattccgacaatttcataagattaaaccacataagcctgttttatgataaaaaagatattttaagagacatcacatttcagataagcaacaaagacagaattattcttcaagggaaaaacggaagcgggaaaagcagcataataaaattaataaccgacgaaaatataagttatgaaggagatttctataaagcaaaaaatttaaaaatatcttatattcctcaggatacgtcttttttaaaaggttctttggataattttataaaagaaaaccaaataaacgaaaccatatttaaaacaaatttaataaaattaaattttgaaagaaaggatttcgggaaaaatttggaaataatgagtcaaggagaaaagaaaaaaattttaattgcgaaaagtttatccgaacaggcacatttatatatatgggacgaacctttaaactacattgatgttttttccagaatgcaaatagaaaatttaatactcgcatatcttcccacgatgctgataatcgaacacgacaaaacatttataaacaaaataaatacagaaataataaaactttaaaccattactagaataaaataaagggaaaagacataaaggaagtaaaagctcaattgactaggagtagtaaggtgaaggttaaagtaaaattaaaaaatatttctccatattcaaaagggcaacaagtgaataaagaagatatagcttataatgccaaatataattacttaaatggaaaaattcgggtaaagttaacttgtataatgttgatataaatgccattacgattagtgaatgcaataattcttgtgtttatgtaaactatatagattatctgggcgtggaacacattgttattatcagatgaaatataaaatgatattttgtagaaattaattaatcatgatttatttagaaaacaagtacaaaatatttcaagcggttcagcaaagtcaatgtataatatatctaaggaaagattaaaaaatcttttaatatatttatcctaatagaactacaaaatcaatttgccgattttgtaaaacaaacggaagaaagcaaagaaaatataaagaaatcacttgaagaaacgcatgtgttgtttgataagttaatgcaagattatttttagggggtggggtaacttttccatccgtaaaatgcggggagcattttgcgagatattgaaaagcgtttaatcctcttcgcctagaagcgtcctttttattcaacttttttatgcgagtaaaaaaatcgtgggttattaagggttgaaaacccttaaggaaattaaatatgaggtttataaggggctaagccccttaataaatttgttattacactaaaaaacagcaagccaaacttgctgtttttttatttgattatttgctcaacaaatcttcttttaaaaattcaacaccggtatcagctgcatctgctattgtcttttgaatgtcttccataagtcttgcaaaatacatttgagattccaagaaatctttaatgtctgaaatatttgacattgtagaatataataagttaaattcacttatcattttttcgtcaggttgttcacctttcatttgagcaacataagatttatactgcatatccataaaatctttaatcatctttttatgctcttcgcttttatcaatcttttcacttgcacttttgtatcttttgaattcatcgctttcttttatagctcttgcaagttcgtttgctttatcatatacattcatactaaaatcctcctttaaatgctaatctactcttacatacataagtataggtaaaatcataggtcttctctttgtgctgtcatataaatacttttcaagatcatatttcatatcagctttaatactgttatagtcaaacaatctgtctttgtatttatcaagcaccttgtttgcaatttcctttgctccgtttaaaagctcttcgctttctctcatatatacaaatccacgggaaactatccccggtccgcttactactctttcttttgttaaggaaacaacaacaataaatagtccgtcttcgcttaacttctttctgtcttttaatactatgttacctacatcccctatgccaagtccgtcaataagagtcattccgtttggaacttctcccttgattttagccttttcaggtccgatttccaaaatatccccgtttttcattacaaagatattttcttctttcatgccaagctccatagcaagttcttgatgctttgaaagcattttgtattcgccgtgtgcaggcataaaatatttggctttgataatggaatgcataagtttaagttcttctctttgagcatgtccggaaacgtgtattccttccgctccttgataaacaacttctgcgccaagttcaaacaagctgttaataacttcggcaactgtcttttcatttccaggaataggagttgctgaaataataacaaaatcttcgtttgaaattttaaattgtctgtgttctccgtttgccattctgctaagtgcagccataggctcaccttgagaacctgttgttaatattactactctttcaggtgggtaattatcaacttcatttaactcaatcattatgttatcgttaaattttaaatatttaagttcttttgctaccgatataacattgaccatacttcttccgcttatggcaacttttcttttgaattttttggcagcatcaaatatttgttgaactctgtgtacgtttgtggcaaaagtggcaacgataattctcttatctataccttctttaaataaagacataaaagttcttccaacacttgcttcagactttgtagcaccttctctttcggcattggtactgtctgcgattaataaatcaaccccttgtgcacctattgcagccattctttgaaggtttatttgttgattgtcaacaggagtataatcaactttaaagtctcccgtatggaatacttttccgtaaggactggttatataaagtgcgcagctgtctggaatagagtggtttgatgttacgaattccacgctaaagccttttacatgaaccgtatgacctctttttacgatatgaagctttgtgctttcgtcaagtttgtgttcaacaagtttatttttcaataaacccattgtaagttttgttccgtatataggaatattgatttgttttaataaataaggtattgcacctatatggtcttcatgaccatgagttaaaaataaacctcttattttgtttcttttttctattaaataagtaaattccggaataacaatatctattccatacatattttcatcagggaatttaagcccgcagtcaaccaaaattatatcttcttcagtttcaaaaacagtaaggtttttccctatttctccaagacctccaagaggtattacttttagttttccgtttatatttgacacgttattctcagctttcttttgatttttggtagctttacgttgaatattattcctttgtattttatttttgttatctttatgctctaaatatttactcgaagaagaaagaagctttttttccttgctttcgattctttttactcccgataaaggagtagcttcaaaattattttttctaaaagccatttcttcccctattcaagctcattgtcataatattcacttactctgttaaattcgtcttcgtcaacaacttccataactaccaaatttccgtcttcgtcttcatcaactgtaaacaaatatgcatcttcatcgttatcttcttcatataaaactaaatatgatttgtcttcaaactcaaactcgtcttcaacaaggaaagatatttctttgccctcctcatcttttaaaacgatgacttctgtgtttttttcttcgctcatttaaaaacctcctaaattattattataatcaagatatgacgataaaattatttgtgctgccatcatatcaataacttctcttttttttctccagtttactcccccggcttcaagggctctttcagcttctttggttgaaagtctttcatcccaaagtttaacgggcacatctaattctttttttaaaatttcataaaattcttcggtgatttgggctctggtacctttttctccattcaaattaagaggattacctaaaataacaagccctgcgtcataatccttgatgtgtttttttattttttctatatcctcttttatgttttttgttctttttataacacatataccttgtgcggtaatatgtagtgcatcacttacggctacaccaatacgggcttcaccgtaatcaagtgccaatattcttttattcaatatatactccttttccccatttgcaactaaaacctacttatattaaataagtaggttttaattaaataaatctttagttttcaaacgtactgtatttattttaaatcattaaaatattttaatactattaattccaaaatttcatctctttcaacttgtctgataagttttcttgcatctttataagaggtaatatatgttgggtcaccactcataatataacctaccaactgattaacaggattatatcccttttcctctaatgctgtttctactttttttaatgtctcttcgataagtttagaacgatcgttttccaaactaaattgcatagtaaaattactgttactgttatttgttcccataatatcaccacctatatataaattttaacctataaattacgattattcaagttttttatttattaattaataattataatgtttctttaatgaaatctttggcattatcaagagccatatcagctttagaaatatctttaagtccggcttgagccatatcaggtcttccgccgccgccgcttccgatactttgagctactttcttgatgaattgtccacagttaaatccaccttttactgtttctttatcggcagaacaaatcataaatcctttttcacctttaacgcttacaaggaatacgataactttagcttctttgtcttttattttgtcgctgaaatctctaagttcgttcatgtcaagaccgtcaacttttgccataacgcatttaataccatttacgtcaaatgcttcgtcaatgatgtttcctaacttatctttgttagcttctttcttgaacttatcaagttctttttccaaagatttgtttttatttataagttcttctactttttcaattatattattgttattaagtcttaatttgtcttttattgtaagaagttcatcataatttttcatattttcttctattgcagctttaccggtaatagcttcaattcttcttaccccgcttgcaactgaagtttctgaaacaattttaaataaacttatgtcatttgtgtttttaacatgacatccaccgcaaagttcagttgagtaatcacccatttttacaactcttacaatgcttccgtatttttcaccgaataatgcagtagcaccaagtttccttgcttcgtcaatgcttgtttcaaaatattcaactttatcttgatttaatatttcttcatttacttttctttcaacttcttttaactctgcatctgtcattttttcaaaatgagagaagtcaaatctaagtctttcactgtctacataagaacctgcttggtttacatgttcccctaaaacttcttttaaagctttgtgaagaagatgtgttgcagagtggtttctttgtatgtttagtctgtcggctctgtttactttgaagttatattcatttcctgcttttaatacgccgtcttttactaatacttcatgaacgaatttatccccgctttttgttacgtttaatacttctcctttaaagtcttctgattcaatgatacctgtatcatttatttgaccaccgcttgttgcgtagaatgaagtcttatcaaaaataacaagtgcttttccttcgtttaattctttaaccatttcaccgtctttgattatttcgataacttttccgcttccgtttaaatcttcgtatccgatgaattttgtgctttcaagatttgcgataaagtttgttaaatcccctttataacttactatatctttgcttgatcttgcgcttcttgctttgtctttttgttctttcatggctttttcaaagccttctttatcaactttaattcccttttcttcaaggatttccattgtaagttcaagagggaatccataagtatcgtaaagtttgaaagcatcgtcaccttttaatgtgtcgccttctaagttttccattaattcttcaattaaagaaagaccttcttttactgtttcattgaatttttcttcttctatatttataagttttaatatagttgtttctttttctcttaaagcaggataagcttctccggaaatttcgattacctttttggcaaccccttccataaaatgaccttcaataccaagaagtttaccgtgtctcattgctcttcttaaaattcttttaagaacatatcctcttccttcgtttgaagttaggataccgtcacttgccataaatacactgcttctgatatggtctgttattactcttattgaaatatcgtctttttcattttcaccatattttttacctgatatttcacaaatgtaatcaaggatatatctgattgtatcaacttcaaaaatattatcaaccccttgaacgtatgcagcaagtctttcaagccccattcctgtatcgatgtttggatgttcaagtctgttgtagtttccgtctttgtctttgtcgaattgtgtaaatacaaggttccatacttccatgtatctgtcgcagtcacaacctacaccgcagtcaggagaatcacatccgtattcttctcccctgtctacataaatttcactacatggtccgcatggtccaagaccgatttcccagaagttatcatctttaccaagtcttgtaattctatcatcagttaaaccgatatcttctttccaaatttgagctgcttcatcatcatcttcataaacagaaacataaagtttatctttatcaagacctattttttcagttaaaaattcccatgcaaagttaattgcttctttcttgaaataatctccaaaagagaaattaccaagcatttcaaagaaagtaccgtgtcttgctgttttacctacgttatcaatatcaggtgttctgatacatttttgacaagttgtaactctctttcttggtggaacttcttcccctataaaataaggtttcaaaggagccattcctgagttaattaaaagcagactcttatcgttgtgaggaacaagagaaaagctttcaagtcttaaatgtcctttgctttcataaaattccaaaaacatttttcttagttcgtttaatgagtatttttccatatctatctccctgtgttagtatgttattttatatctcctgattttttaaggccctgtgccgttaggataggaccgactatttcaaaaacaaatgttgcacccataattatatttaaaaacagtgtactgtattcaggcatcatttttgatgccgcaaccgcgagccctactccgactccggccatgggcataagccccattccaagataattccttgtaactttatctgtccttgccataccgcacccaagaaaagcaccaagaattttacctataaatcttgaaattacaaaggctattccgattgcacctatacttactattacatttaagtccaaactgtatccggcaagcacgaaaaatataacgtaaatcgggtttacagcttcttccgtcatggaaaagactttgtcgtatctaaagcatagattagctatcacacttcctgttgccatacaaacaagaattgaagaaagttcaaaatatgtacctattcctgaacctaaaagaacgcttgcacaagcaacaataagcacttgagatttatcccttctgactttcttttcaataaagcagaacacaagccctataactccacctactattaaagataatacaatctcttttaaaggagcaagtaaagcagaatttatattaaaatgtccgcttatcatagactgtgaaactgcacatgcaatactgaaaaggaataaacatacggcatcatcaagggcaacaaccgtaagaattgtatttgtaagttttccttttgccttatattcgttaataacattaaccgttgcggcaggagctgtggcagcagataaagcaccaaagactattgataacggtaaatctcccgttacaatataaactcccaaagttacggcgattatagtaacggtagcttgaactatcgttattaaaataacgcttccgccaaggctttttattttatccaagttaaaactttcccctatgttaaaggcaataaagccaagggctacatcttgcagaaattcaagttccaaaaggatatcttttggcagaatatctataaatgatactccaaggattaaacctgcaagcaaatatcccgttacagcgggaagctttaattttgaacatattttacttatagcaaatcctacaaaaaggaataacccaagagccaataattcatccatttttcttcctcaactttagatgaaaaactctattgtcacatcatatatgattctatttcatccgtttctttcataatattctttgttaaattaatgtttccttcttttgttattaaaatattatcttcaatgcggattccaattccttcttcttgtaaataaagtcccggttcaacggtaataacattaccggctttaagaggtttatctttatcgaatggatcatgacagttaagtcctacaaaatgggaaacgaagtgataataataattatttacttcttctctttcttctatcaaacctatttttttaagttcctcttcataaatatcaattacaatatcgttaagttcttttaaggttacaccttcttttgcattttcaataacggttttgttcgcctttaaaacgatattatatattatcttttggaaatcagtaaattttccgtttacgggataagttctgcttacgtctgcactgtatttatttaccgcacttccgcagtcaagaagaacaagatctccgtcttttactttatcctttcctttgatatagtgaagagtagtagcatttttaccgcttgcaacaattgtcgggaaaggcagtgtatcgccgtttttccttgtaatataatcaattgtagcggcaatttcagcttctttcacaccgggtttggtaatcttcattgccatgtttatggcattttttaaattctttgcacctttgtgaatacaatgcacttcgtattcactttttacttctctaagttcattaaggcatcttttgatattataaaattccaagttatcaaatactttatacatttgtttaaacattctaaggtttaagttataattctcgctggtatttgtatcatccaaagcaaaataaatcttctctaaagtttcatcattgccaagttcgtttatatattcttcaaactcatcaagataaaaaacatcttccatgtcgctaagtgccataacttcaggaatagataattttatccccgtccattttgaagaatactcgttgttttcaggaataaataattgttcttttatttccttatcattctttgttaaaataagcacacagtcttcttcgtcaatgtttgtaaggtaataaaaatctctgtttacttcaaattcataatcatttccgttttcacttcttacaagttctccggaaaagaaaaccgcagccgaattatcgtccatgtattcaagtactttttctcttcgtttttttaaatttagattattcataacctgcctcatttacctttataataactaatttattttaccatagtaaaaaaattttatcaatattttaaacttctacatttgcccttttatcaatatttttccatatataaatcatattgtaatacaataacttaaaaatatcaaacatacaaaatttattaaattaaaatcaatatatatttatttataaaaacctcttatttagttaaatcccaaataatattaaattaaaatttagaaaaaatttccaatatatatatttgtttttggggaaaaattaatatagaaaaaacaaaggagaaataaaatggctaagaaaaaagaaaacaaaaacaataagcaaaacatgaataaaaacgaacaatcttataacaacaaaaacgaacaaaaacaacaaaacaaaaacgataaaaattgtaaataactaaaaaagacactttaaaaagtgtctttatttttttctttaaaaataaacaatttactaaaaatataatttaaaataacaacaattatacttacagttactttagcaaccattccctcaatacccaataaaatacaatttaaaacaatatatgcaatttttattatacttataaaatattacaaaactatatattttttaattaaaaacaaaataacaataaaaaatattgtcattttatcataactgtaaactatacaaacttacaaaattttctcaaaaaaaagactcttaaagagcctttttctttttatcaacaaatatataaatcaaacaccctaaagccgtaattaatgtaattatacccccttctttaatccctggagtacagtatttaaacactacttcatttgcccctttttgaagttcaactcccatagaatcaacgtttgcctgtaatacatcaacttccttaccattcacatacgccttccagccttttgaataaggaatagataaaacccctattttatcttctttcgtatttacatttaaacttactgtatttccttttatggtaaagttttctaccttatcttcctttaattcatttacatatttatcatagttatccatagactgagatactacttttaaatcagagaagttaaattttccttttttcgtaaaattaagtttaatttcatgttctccatcttcataatatcccaaatttaatacataatcatttttacctacataataagtatccgttgtagatctaataatatacttatcattatatttttttgaagaatctatatatatttctatgtctgattgagtttcacttgaggataatagatatttaaccttatcttttatacctgcatttttcttttcttttttttcaataactaaatttaaatcatctaaaactaaatatgtttcactgtttttaataggttttatatttaatgttatagatgaattatcctttataacatttatgcaatcatcttttaattctatatttttttcattatattgggcattttgtaatatatcttcaaaattcataataattttcttctgttaagatatttccttcttcgaagtttataaatgttttgaaacaccttatagatttgtttttgaaatctatccaaaggaaatagattttaaaaaaggaataagttatgctagttcggttatttataatgttgaaaaaaataccggaaaatatagagaagattccttgggagattctttttacatgcttgaagaagaaactttaagagaatataccgataaagaattaaggcatttaaaataaggtatattttctttgtttataaattatattgtaaaaatattatataaaacctactatacaaaattcatatgtcaaccaatattatatttaatgttgacatatgaatttttgttttataatatatttatgggtgaaaaatatgaataaagataaaatacttgaaatattaaaagtgaaaagcggtgaaattgtttcagggggctttattgcaaataaacttaacatatcaagaaatgccgtttggaagaatattaatctgcttaaaaacgaaggttatgatatatcttccataaaaaacagaggatatatgctaaacagcaatataagttatttaaacaaagaagaaatagaaaaatttctaaataccattttaataggaagagaacttgaaatagttgaaagcatagattctactcttaactattttaaaaatatggaaaatagtgaaaaaagagaaggaagaaccataatagcaaatgaacagactttaggcagaggaagaagaggaagaagtttcttttccccaaaaaactcaaatgcttttataagtgttttgttaaaaccaaaattcagcgtaagtgacataaatttaattactataatatgcggtttaagtgtagtggaagcagttaaggaaatatgcggtattgactgcgacattaagtgggtaaatgatgtttatataaacggaaaaaagatttgcggaattttaacagagggaattttaagtgttgaaaacggaagtatagacagtgtgattataggagttggaataaatataaaccgtccaaaagatacacccgttccaaaagaaatagaagatatagttgggtttgtaaatgactttacgggaaagaaagaaaacagaaataagtttatagcaaaatttttaaatgcctttgaaaaaagatatattaattttgacaaaaaagctttatatgaagaatacaaagaaaaaatgctatacttaaacgagaaagtaacttgttttatcggaaatgaaacaattcaaggaacccttgttgatttaaacaaagatttttctattaagataaaaacaaatgagggtgaaataaggaattttaacagcggtgaaataagtttaagaaaaagaggaataaaaatgtaaggagtaattatggacagtaaactaaaatttagatttgcaaaaaaagaagatacaggcttaattcttaattttatcaagagacttgcagaatatgaaaaaatgcttaacgaagtggtagcaacagaagatttacttaaagaatggatttttgaaaagggaaaggcagaagtaatatttcctttatatgatagaaaagaagttggatttgctttattcttccataatttttcaacattccttggaagaagcggaatatatcttgaagatttatttatcttggaagaatacagaaataaaggtattggaaaagcaactttaaaagaacttgctaaaattacagttgaaagaggctgcggaagacttgaatggtcttgtcttgattggaacaagccaagcatagatttttatttatctctaaaagccgtaccaatggaaggatggacagtatacaggcttacagggaaaaatctcataaatatggcagaaaataattaaattaatacattaaaaaagatgcttaaatataaaaagtgtcttttttattttcttattacaataatggaattttttgtgataaagataatataaaacattctatttttaattttattatattcttttataacaaattcatataatttcattatgacaaaatcatttatccaaagaatgtaaaatgtttttcgaggtgggatatatgagttttaaaaagaaacatttttttgtaatttttacttatgtacttgcatatttattttttaggagagtaaagaatccttctttgaattacatatgtattctttattataaagatagatttatttcatttaaaggttttttagatacgggaaatctcgttaagaattcaaagggaaaagatgtaataataatagacaaagacattattaaaaatcttttaaatttgaatttatcttttaaaacaatgaattacaacgatttttttaatacatataacaaacttcctttcgatttaaaacaaagactttcttatacatttttaaattatcaaagagaaaaaattattttacctatcttaaatttagacaaaatcattatagaaaaaaaggattttaaaaagacaatttataatccatgtgttggagtattagatattaatgagtcgttggctcttcttccgttatcaatattaaaataaacaggaggctttatgtttaaattatttactttgtttaaaaaaaacaaaaagaataaattattttatatttcgggttcttatatgttacctcctcctttaacaaaggaagaagaagcaagaattttgaatgaacttcaaaagggtgaaaataatgctgcaaaaacaattttgatagagagaaatttaaggttagtagtatatatagcaaaaaaattcgatacatcttcaacaggggtggaagatttaatttcaatcggaacaataggacttataaaagcagttaaaacatttaaagtagaaaagaacataaaacttgcaacttacgcatcaaaatgtatagaaaacgaaatattaatgcatcttagaaaagtaaacagaataaaaggcgaaatatctcttgatgaacctttaaacgtagattatgacggaaacgagcttttactttcagatatactgggaacagcaacagaccctgtaaaagataaaatagacagagatgttaacaaggaaattatgcttgaagcagttaataatttaaaagaaagtgaaaaagaaatcataaattatcgctttggcttaaacggaaaagagaagaaaactcaaaaagaacttgcaaatatgctaaatatttctcagtcttatatttcaagactggaaaaaagaataatatctaatttaaaaaaggaagtgaaaaagatgtgtacataagaaggtttataccttctttttttaataaataacctaactttgaataaaaggtatttattttattttaaaataatgttattatttatcttagaatatttaagaataaaattctaacaaatatacactttttatatttcttaatactaagaatttttttttattacaattttaaaatattattcttaataattttataatctgcctttttaagataaggtaaaaatatttaaggagtattattttgaatttagaggatattataagcggttacgattatgagttaaccaaggggaaaaatatagaaaacataaaaattgacaatatagaatttgactcaagaaagtgcagtaaaaacactttatttgttgcaataaaaggttacgaaaccgacggacataaatacataaaaagtgcaatagaacttggagcaacagtagtttgtcacagtgaagaacttgataaatatgaggaaaacatagtatatataaaatgcaaaaatacaagaaatgcacttgcatattttgcaaataaatttacttcttttccaagcaaggaacttaagttaatcggaataagcggtacaaacggtaaaacgtctttttgtgatatggcgggaacattatttgaaaatttaggttttaaaagcgattatataggaactttgggaagaaaaaatacaaaacttgaaggtcaaataataagaacaacgcctgaaatcacagaacttacaaaagacttcagagaaatggtaaataataaagtagattattgttttatggaagtttcatcccatggtcttgttttggacagggtaagctatttgaatttttacataggtgtattttcaaacttatctcaagatcatttggattttcataaaacaatggaaaattattatcaggcaaagaaaaaactttattatatggttgataaattcagtattataaatacagacgataaatacggtaatagactttataatgagttaaaagaagataaaataaacgtaatttcctttggcatgaatgaagactgtgattataaaatagtaataaacgatttaagtttggaaaaatccgattttactttggtaaataaagataaagaatatagatttgaaacttacagtatcggaaagtttaacatatataatattacaccggcgataataattgcccttttggaaggtttttcttatgaagaaataaaaaatgcaattaagaaatatcacggtacaaacggcagagttgaaaaaatccataaagacatatttatagattatgctcatactccggacgcaatggaaaatgttttaaaactcgttaaagaagtaagcagtaaaaaaattactcttgtgtttggatgtggaggaaacagagatcatgggaaaagacctatgatgggaagtatcggtgaaaaatatgctgataatatagtcttaacaatggacaatccaagaaaagaaaacaacgacgatataataaatgatatcctaaaaggaatagaaaacaaagacaaagtcaaagtaataaatgatagaaaagatgctataaatgaagttgtaaaacataaattaacagatgaaaacgaaattgtacttattcttggaaaaggacatgaaacttatcaagaaataggggataaaaagatatttttctctgacagagatgaaattttaaatgctttaaaaaattaaattacaaattacatattttagatgggaataacaatggaaagaaagaaaatatatatagttcttacaagcacaagaacaatgttagcaagagcaataagattatgtgcaaaagaaacttacaatcatgtttcaatatctttagataaagaacttaatgaaatgtattgtttcggaagaagaagtccaagaaatccttttatagcaggatttataaaagaagattgggataagggattctatgctgtatataaaaatataccttgtcttgtttatgaatgtgaagtagacgatgaggtttataataacataaaagggataattgaatatttttattcaaataagttttcatataaatttaatataatcggacttgtgggaaatggaatagggcttgacatacaaagaaaaaacagatattactgtgctgaatttctatcctatctttttgaagaaagcggattttattcatttaacgaagcccatacaagaagacgtccaatggattataaagaatttttaaacagcaaattaatatacaatggttatataagtgaatataaacataaatgtgaacaattaatataaaggataaataatatgaaattgattttagctgttcttgcaggacttatatttattgtattagtctttttatatgcaagaggacttatgcagaaatataataaaagaattgattctacagcaagacactacggatacagaaattataaacatatggcaaaagaagcagaaaaaaaagaacaaagaatattaagacaaagaagaatagagcagaaatttaaaagagaggagtggctaagaagacatggaaggtaaaataaatttttcggcatcttcacctgttatgccaaaggaagtaatagaaagaataaataaaaatataataaacttcaaaaacagcgggttttcagccttagaacttaactataaaaatcctctttttattgacttaatgaatgaaacacgtgaaatacttaaaaaacttcttcatctaaatgataatatggaaatattatttataaacggaggaggcagtatgcattttgacatggttcctctaaactttacaaatgaagatgatacggtaagcataataaacagtgatttatggacaaacaatgcagtaacggaggcgagaaaatatgctaatgtagatgaaataaatctaataaaccataaaggtccgcttccaaaaattacattagatgacatagataaaaacagtaaatatttgtttatgtgtacaaacaatacttcatcaggttctaagtttaataaagataaaatacctgatgtagagggaataccattaatttccgatatgacatcaaatttgttaagcgaaacatatgatataaacaaatttgatttatcttttgcaagcagtgcaaaaaatatgggaacaagcggtatcagtgttgtagttataaacaaaaatttatttgagatagaaacaaacagaaatgttcctaaaattctatcctataaggactattattactcgggcaactcctttacaactccaaatacgtttgcggtatatatcatttacgaaatggttaagtacctttatgaaaatggtggggtagaggaaattgaaaaaataaatattgaaaaatccaatttattatatgattttatagataacagtaaattttacgataatgacatcataaaagaagacagatctgtaacttctttgatatttaagacaaaaaataatgataattttatcaaagaagcaaaaaaacatgatataataaacatcagtacatccatgaataatgccgtaagggttgggctttataatggagttggtattgaaaatgtaaaaaaactgatagactttatgtatgagtatgaaaagaaaaacatttaaggagagtgtcaaaatgtacaaaatcaaaacttttaacaaaattgctgaagaaggattaaatttacttgggaaaaatatagaggttcaagactctaaagactacgacggaattattttaagaagctacaatttaaaagaagagcctatttcaaaagaatgtaaagttattgcaagagccggagcaggatataataatgttcctgttgaagaatgtacaaaaaacggtgttgttgtaatgaatacaccaggtgcaaatgcaaatgcagtaaaagaacttgtattatgcgcattccttatggctgcaagaaatatcatcaaaggaacaaaatgggttcaatcattagataaaaactctgatgttaccggaataattgaaaaagagaaatctaattataaaggaaacgaacttgcagggaaaaaagtcggtgttatcggtcttggagcgatcggtgttttagttgcaaatgcacttgactctttaggtatggaagtttatggttatgacccatacttatcagtagaacatgcatggagtataaataaaaacatcaatagaagttatgatgtagaaaaaatatttgaaaaatgtgattttgtaacaattcacgttcctttaatggaatcgacaaaagatacagtaaataaagaagttttagataaagctaaagacaatattaaaatctttaaccttgcaagaggtgggcttgtaaatgatgatgatattttagaagctgtaaatagtggtaaagtttcttgttatgtaacagatttccctaatgaaaaattacttggaaacgaaaatatcatttgtattcctcaccttggagcatctactccggaatcagaaacaaaatgtgctgtaatggcagcaagacaagtaagagaatacttagaaaatggtaatattataaacagcgttaacttccctaactgcgatttaggagcaatagaatcaaaagcaagaatttgtattattcataaaaacattcctaacatggttggacaatttactgcattacttgcaagcaacgatgtaaacatcgcaaacatgattaataaaagtaaaggtgaaaatgcttacacaatgattgatactgatacagatgtaagcgaatatatcgaagaaacattaaataatgttgaaggtatagtttctgtgagagtactacataatgactaataatttatctaatttagatgttataatcataggaggaggtgctgccggtattatggcggctatctcctctttagaatgtaataaaaaagttttgttaatagaaaaaaacgaaaaaataggcaaaaagatttacataacaggtaagggaagatgcaacgtaacaaacaataaagatatatcggaattctttgaccatatagttaaaaataaagaatttttatatagtgcattatacacttttgataatacacgtcttcttgaaatgcttaacaaaaacggactaaaaacaaaggttgaaaggggagacagagtttttcccgtatcagataaagcaagtgacgttacaaaaactcttttaaatatagctaaaaaatatcctgattttaatataatgtataatatagaattaaaggatataattctaaacgaaaataacgaagccataggggttttgcttaataataaagaaaaaatatatgctaaaaacattatccttgcaacagggggtaaaagttatccttctacaggaagtgatggatacggatatatagttgcaaagaaacttgggcataagattataaatccaatacctgcccttgttcaaatattaagcagtgataagtgggttcatgaacttatggggcttactcttaaaaacgtagatgtaactttaatgataaagggtaaaaagaaaaattcacagtttggagaacttctatttactcataaaggtatatcagggcctacaatcctttatttaagtaattttattaatatggataaattatctgatacaaagataaaaatcgatttaaagcctgctcttgactttaaaactcttgaaaaaagattattaagggattttgaaaagaaccaaaataaaatggtgaaaaattcacttgatttacttcttccaaaatcacttgcggcaaaaatcatagaactaagcaaaattaacaaagaaaaacagataaaccaaataacaaaagaagaaagaaaaatcattttaaatttaatcaaagacttacaagttaatataacaggtcttggaagttttaaagaagcaattataacaaacggaggaataaacgtaaaagaaataaatccttctacaatggaatcaagacttataaaaaatctattctttgccggagaaataatcgacgttcatgctgttacaggtggatataatttacaaattgctttttcaaccggttatctcgcaggacaaaatttacattaagaacgcataagcgttctttttttattaaaaaaagaaggaaaaatccttcttttaattttatgagaacattcttattacaccgataacttttcccaaaatctgacagtctgttgaataaataggctcaaaagctgggttttcaggttgtaatcttatcctgtttggttctttgaaaaatgtttttacagttgcttcattttctattaaagcaacaaccatatcatgattatttgcagtattttgtttttttactattaccatgtcaccatcaagtattcccgcatctttcatactttcaccttttacatttagcataaaacattcttttgttccaacaaaagaacttggaaggggataagtatcttcaacgttttcttcagccaaaataggaagtcctgccgcaacgtttccgattataggaacatttatgacatcatctaccatactaacttcatcataacttggttcattatttgtaaaaggagaaaacccaacaacttcaatagctctttgttttgatactcctcttttaatatagccttttttctcaaggttgtttaactggttatgcactgaagaagttgaagtaagaccaacatttgctcctatttctcttactgatggcggataacctttatctttaagttcttgttttataaactctaatatctttatttgaattttggttaaatcattatacataaaaatgacctcctactattatataattatattatacataaaaaacgaacattgtcaaacttatgttctaaattattcaaaaatttgttctaaaaatattgacaaatagaacaactgtttggtataatacaaccatagaaaacgaacaaaagttcttttatattaatagggggacaaaaaaatgaatcaaagaaataatttaaacaaacaaagaagaatgagaatgataagaagaagaaaagcaagattaagaaaaagaatcatttgtactgttatgattatgtttataattgctatgattccttcttttatgaataatattaaagctaaaaacttatatgatgtgcattataaagtttatacagtccaagcagatgatactatatgggatatagcacaaaacattactgatgaaaaaacagatgtaagagaaactatatataatattgagaaattaaataattttgataaaggatattctttaaatgtcggacagacaattaaacttccaacttattaattttattttttttaacagagcaatcgaacaaattatctaatatttagtataacatgaatatatgttcgttgtatcagctcccgaccctctttagggataatataaacatattgtaaactctaaaaaaagactgactggcagtctttttttagtatatttttattaatcttctcttagctttgtaactctagctgcaatttttcttctttcttcctcaattgcggcataatgtttttttgtcgtatttacatctttatgtccaagaacatctgcaacaagatatatgtctcctgtttctttatagagatttgttccgtatgtacttcttaatttatgaggtgaaatatttttaagaggtactacaatctttgtatatttttttagcatcttttgaattgaattttgagtcattcttttgtgttgtaaggataaaaacaaagcatcttcctctacatcaactttttctctatcttccttaagatatctaagcagggcagacctaacttcttctggcatataaagaattgttttatttccaccttttcttgttaccacaaaactgtcattgtcaaaatctacatcgtttatattcattccgacacattcacttatacgaattcctgttccaacaagcaaagtaacaattgcaagatctcttacttttgttttgttgtgatatttaagctgggaaggtgttaagtttttcccgctttctatttcatcaagaaggtttgcaacttcgtttggttcaagtcttacaataggcttttcgtagtttttaggtaaatcaacaagcactgtaggatttgtttttataagttcttttttaaaatagtatttataaaaagaacgaagggtggaaagttttctcatttttcctctatttgaattagataaacttacctttgtttcatcgtttttataatggccttttgtgtaataagacagatactcgctgaaatcttcaatatctactgccttaatataatcaaggtcacttaaacatatatcttttatatctttataatgtgtaaatttaggatgattttctattaaatattcaaagaatatttttaaatccattgcataagctattctcgttttaatggaggtgtttgcggaaattcctctaaaaaatgtatttgcaaatgaaggaagatattcaatttgttttcttagcttaatgtttaatttatttgacatttctttactgtaatcagccatttttacctccaaaataattatataaacaattatattacattattttgaaatttcaaagtcttgtgtggtataatagaaaaagtttagtaaattaaaggggtatagcatgaataagacatttaaagaggcttttaaagtaacaatgccggtacttcttggatatttgtctatcgggcttgcgttcggacttatgatgcaaagtatcgggcttaattttatatgggcagggggaatgtcccttgtaatttatgcaggaacacttcaatatttggctgttatgatgtttcaaacaggaatgagtatgataagtgttgcacttatgacactttttgttcattttagacatatggtttatggactttctttaatagaaaaattcaaagatataagcttttttaagaaagtatatatgatttttggtttaactgatgaaacatatgcgctattaacttcttcaaccgttcctgaaagtgtaaaagacgatgtagaaaactactatttttacatctctatcttagaccattcttactggattataggttcaattcttggtgcaaccataggttcacttataaatataaacacagaaggtgtatcatttgccatgatagcactattctgcgttctttgtacagaacaatggtttaaccttaaatcaaaagtaccgatttttataggaggtatctgtgctttagtagctttatttatttttggacctgacaatatgatgatacctgcaatcatagcaataatgattcttttaatgggagataggaaaaaacttgaaaaggaggggatagtaaatgaataaatatactctctttcaaggtttaatggcaattttaataatgagtggaattactttctttacaagagctgttccttttgtacttttttcaggaaaaaacaaaaaaccaaatgatacggttttatatcttggtaaagttcttccgccggcaatgatggcaatgttacttatatactgtctaaaagatacttctcttatttcttatccttatggaatacctgaaatattctgtgtgctccttgcaatagggctacatgtatggaaaagaaataattttataagtatattcggttcaacagtggtatatatgataatgatacaatatatattcgtttaaaacttcacgaaataattatttagtgaagtaaattatataaaagaggtaaaatatgcaagaaataataaatatattatcaaaagaatttgacagaaaaccaaaacacattgaaaatgtaattgaaatgcttgataaaggggatactgttccttttatagcaagataccgtaaagaacttacaggttcaatggatgaccagcttttaagagaagttgcacaaagacttggatatttaagaaacttaaaagaaagaaaagaagaagtaattagttctattaagaaacttgataaacttacaaaagaacttgaagaagaaataaataacgcaaatacattatctgaagttgaagacttatacagaccttacaaacctaaaagaaaaacaagagcatcaattgcaaaggaaaaaggtcttgaacctttaagtgatattatactttcgcaggaagcagatttagaggatataaaaataatcgcaaaaaattatgtaagcgaagaaaaaggcgttaataacgaagatgaagccattaaaggcgctttagacataatcgctgaaaacatctcagacaatgcaaatataagaaaagagcttaaaaaactaatcagaaacaaaggtaaaataataagcaaaaacactaaagatgaagacagtgtatatcaaacttactatgaattttcagaatctgtaaaaagacttcaaggacacaaagttttagctttaaacagaggagaaaaagaaggatttttaaaggttacaatcgaaattaataaagatgaagccttaaatataatacataaatacgttataaaaaatacaaaaagcagtgcatataaatatttagaagaaacttgtattgatgctttcgacagacttatttttccttccattgaaagagaaataagaaacgacttaacggaaagcgcaaacgaaagtgcaataaagacttttgcaacaaacctaaaacagcttttaatgcaaccacctgtaaaaaacaaagtaacccttggacttgacccggcttatagaacaggatgtaaaatcgctgtagtggacggaacgggaaaagttttagacacaaccgtaatttacccaacaccaccacacaacaaaattgaagaaagcgaaaagataattaaagatttaataagtaaacataatgttgaagttatttcaataggtaacggaacagcatcaagagaatcagaaaaatttgttgccgatacaataaaaggcacaaaggttcaatatgttgttgtaagtgaagccggagcatcagtttattcagcctcaaaacttgcagcaaaagaattccctgattatgatgttgccttaagaagtgcagtttcaattgcaagaagacttcaagacccacttgcagaacttgtaaaaatagatccaaaaagcataggagttggacagtatcagcacgatatgccaaaggctaaattaaatgaagcattaacgggtgttgtagaaagtgccgtaaacagtgttggagtagaccttaacacagcatctgtatcgctacttgaatatgttgcgggagtaagcagtgccgttgcaaaaaatatcgtagcatatagagaagaaaacggaatgtatacaaaaaggagtgagcttttaaaagttccaaaacttggtaagaaatcatatgaacaatgtgcaggtttcttaagagttgcagaaagttcaaaccctcttgataactcaggagttcaccctgaatcatacaaagcggcaaagaaagttcttgaacttacaggacatactctaaaagacattaacacagaaaacataaaatcaataacagaagaagccgaaaaaataggtcttgataatatttcaaatgaatgtgaaataggtataccaacacttaaagacatactaaaagaattaatcaaacctggaagagacccaagggatgaacttcccaaacctattttaagaagtgatgtaatggaaatggaagatttaatcgtaggtatgaaacttatgggtacggttagaaacgttgttgactttggagcctttgtagatataggagttcatcaagacggacttgttcatatctctcaaatatcaaattcatttataaaacaccctagcgataaacttaaaacaggggatatagttgaagtaaccgttactgatgtagataagaataaaggaagaatttccctttcaatgattatgtaatataaagccgtgatgtacacggcttttttataatacaaaacctaatgcaataaaagacttctacgaaaatgatgaacttataatagttacaaaagaactaactgaaaccctaagaagaaataaaaccatagactggcaaatgagagaatcggcaagagcaaaaatgcgaatgattattaaaagacttctacgtaaacataaatatccacctgaaggtatggatgacgcagttaaaaccgtaatggcacagtgcgaaatgtgggcagataatttataaaaaagacctaacaggtcttttttgttttaatttatatatactttttaggtatatatatatcaataaatatagaatttgatatatttagtattttaatttaaaataaaaatatataaataaagtattgacatggagtaaactccaagtgatagactaagcctaagataaaacaaggaggttttataagatgaaaaatacattagttgcttatttttcagcaacaggaactacaaaacataaagctcaaatgctcgctgaagctttaaattgtgatatttatgaaatagagccaaaaaatccttacacatcagcggatttaaattggatggataaaaagtcaagaagttctatcgaaatgaacgataaatcttcaagacctgaaattatagataataatccaaatattgaaaactatgatgtaatattcttaggtttcccaatttggtggtatacagcgcctactattatcaatacattccttgaaaaatacaactttgaaaacaaggaggttgtattattcgcaacttcaggaggtagtggtctaagaggtatttcaaaggatttaaaaggaagcgtatctgaaagcactataataaaagaaggcaaaatgttaaacggtaatattacaaaagaagcattagaaagctttgttaaaagcttaaatttataatataaaggagaagaaaattaaatgttaggaaatttttcatattcaaaccctacaaaattatattttggtgaagattcattaaactatttaaatgatgaattaaaaaattatggtaaaaatatcatgcttagctacggtggtggctcaataaagaaaaacggtatatatgataaggtaatcgaaattttaaaagcaaatgacaaaaacatttttgaagatcccggagtaatgccaaacccaacagtagaaaaactttatgaaggatgtaaaattgctaaagaaaataaagtagatttaattcttgcagttggcggcggttctgtatgtgactacgcaaaagcagtttctgtttcaacttactgcgatgaagatccatggaataaatactatttaagaatggaagatgtagataatgaaatcattcctgtaggatgtgtacttacaatggtaggaacaggttcagaaatgaacgggggagcagttattacaaatcatgaacaaaaattaaaaataggtcatgtattcggcgaaaatgtattccctaaattctcaattttaaaccctacttatacttatacacttcctaaatatcaaatggtagcaggtttttacgatattatgaatcatatcacagaacaatatttctcagatgatgatgacaatacttctgactatattagtgaagggttacttaaatcattaattcatagttcaagaatagcagtaaaaaatccaacagattatgaagcaagaagtaatataatgtggattgcaacatgggcattaaatactttgattgcaaaaggcaaaacaacagactggatggttcatatgataggtcaatcaatcggtgcttatactgatgcaactcacggtatgactttatcagctatttcaatggcatattatcgttatatctgtccatatggtttaaataaatttaaaagatttgcaattaacgtatggggagtgaatccagaaaataaaactgatgaagaaattgcaaaagaaggccttgacagaatggaagaatggatgaaagaaatcggtcttgttatgaatatcaaagacttaggcgttaaagaagatatgcttgaaggaattgcaaaaggttcattcataatggaaggcggttataaaaaattaagccacgaagaaatcgttcaaatattaaaagaaagtatgtaatataaaaaacagctctatgtagggctgttttttattattgaaataactaatattaaagatacttttatctaaagggaatataaatagtttttaatcaactttccgctaaagacaactttaacatagaattgactatattttataataaatttaacatatttttacacatcttctcaaaccctttgattataaggcttttaagcattaatatctttataatgttattttctattatctttttaatatatattccattttatatctatcccattttaaaatttactaaatggatttttattcatatcaatttcttcttgtttatcttttagatatctttcaatttgtttatctgtttttagtcccaggaatgatttaatttcattaaaacctgcattgttataatctttcaacatttttactgcagtattccttaaaatattgctgcttattcctttttcttcaattcctattctcttaagtgcatttttaacaatttcttgtattcttcttgttgaaattggtttttttggatttgaaggactatttaacaggtatagttggtcgtttgaaaataaaaaacggcttaaaatgcctctgagagcgtcatttattttaacaattctttcattttcactgtttttgtttattatgatattattatcaaaaatatcttcagtttttatgttttgaacttctttaaccgtaagtccattaaataacataagaaaaattattatttgattcttttccggttcaatgttttttacgtaatctattaaatcatttatctgctcattagaaagaacatctttatttaaactatcattattatatctaaatttgaacgaaactatttcgttatttagaccatattttttattaagaaacttataaaagtttttaactgcagatatttttcttgcgatagttttatctgaatttttaagttctttttttaaataatcaacataagcatacatgtcgatactattaaggtttaagaataaatctttatcagcttcgttatctaaattattaatatggtttctcttcatcataaataaaacaaaggtatttaagtcatataaataccctttaattgatgccttagaaatattatttgtatttaaaaattcatttataagtttactttccattttacataacttcactaaatatttatttagtgaagttctctcctatataattttgatttaacattttattaaagtcatcaataacattttgaggtgagacaattttaattccaccctcaaattgaaatatccaagcataaaatgtcggacttagtccaacacgaactttaactaaaaaatcctcttttcctttttctaaaacaggtacaacttccccaaatttatctattatatatttcattaattcattcttacatttaagtataacttctttttcttcccccggaaacatactaaatatctttttcccataatctgtaatagaaaaaccatctgggaactttgttctttcatcatccagcattgttggaatttccatcctatcaactctaaaagaaacaacatcgtttcttttatcggaataacctacaagataatacttatcttgattccaatataaagtgtatgggctaagaatatatacttcaccattatttttaaatattttatctttatttatattgtaatcataatatctaaaagatatttttttatttttatttatagctgtatttatcaaatcaataatataatatattaagttattatttgtttttacttttcctgtgttaataatatttcgattaagatgtcttctttgattttctgaaactaacatcataagtttatttatgataatcttacttttctttttacttataaactgtgaagaagataccgcatctataagcattgcaagctcaggaagctcaaaaagtcgttcaccaaagaaataaatatttttattgcctttctcacaaattatatcatatcccattacttctgacaaaaaagatatatcttcattaaatgtttttctatctatattaatattatgttctttcaaataactaaaaatatcttttgttgttaatggattttcttcgtcgcttttttcataaagaagttttaaaataagaaaaattctatatctgttgtttttcataacattaccactcatttaatattttgattataattattttttataaaaattttctacttcagataaattttttagaccagcatctaataacatccttgcaaattcttctatacaaattaatctaatgttattttcttttgctatattttttgcatcttcactaaattcttttgctgtagtaataacccaatacaaattattataatttttttcatcatcatctatagatacttttttttctattaattgcttatatttttttatttgatttacgccttcttcatatgttttcccttcgtgtttttttgcttgaatatatatattaagttttaaatcactaaaacttgcttttacgtcagcatcttcttcgctttctttttcttttggatttttaggtaaaattattgcatattcagctccaattttttccattaaccattttataagattttcaagtccatcaggagttacattttcttcaatagaaggtattaaacttttcattatattattaattatattttcttctatactaaaatctttttcgctatttattactttatcaatttcaactgataaatcatcaatctctgcaagagtatttcttattttcattcttgccactaaagaaggagaagcaaatgatctttttattctttcccttactttttctacctttgcaacaaacccaatatctttaatttcatcatttaaaactagtccatcatctgttatttttatttttgttttattaatgtttctatctattttaaattctttaccttttaatttaaaaatactgcagggactttctattactttataaatagaaaaatctttattctccataggaactaaaatgtaatcacctttttgatattttgcaaatctccaaattgtccatctttgtctcaaattacctaattcaccattatcagtttgtgaagaagaattttttacggcttgttcaaattcctttacatttgtttttaataaagcttcgggattgtttttatcaatataatctttaaatcctattgaaatataggattcattgttttcacataataatgctttagatactttccattcatttgaaattctatttaaataataatttgacattatatacctcctatttatttatatatcaattttacaacaaaatttataaacttttcaattataaaaaaacagacagggaaatttttccctgtcttatataattctatagattattttatcatttttttcatttttttagctgtttcttttggtgtagaactatttacaagtcctccgccaactattattacatcgggattttgtgcatttatttcttctaatgtttcaagttttacaccgcctgcaacgctgacttttgtattttttactaagcttttaacttttattaaatcatcaagaggggttgcacctttcttttgtatatcagttcccgtatgcacacaaatataatcaacaccgatactttccaaatatttaactctttcttctaaattatctacgcaaattaaatcaacaagaagttctttccctgctttttttacttcttctaaagaatcttctattgtttgattatcacttacagcaagaacagttactatatccgcaccggcatcaagagctattttcgtttcaaatgcacctgcatccataatcttaaaatcagcaagtatctttttatttttaaaggtttcttttaatttttttattccctcacttccgtatttataagcaagaggagttccaaattcgattatatcgatatactcttcacattcttttacaatttcgatactttcctccaaactttttacgtccaaggcaatttgtaattgtttcatttttttcctcctttaaataaaaatccccgcactaaataaagtgcagggaaaatttaatactattcagattttaaaaggtcaccgaagatatcacctaaagttacattaccatcttcttgatgataaactttgtttctttcaatttttctttttggtggatccattgtttctttaatgcttaaagaaacttttcttttatctttgttaatgtcaatgattttaacgttaactttatcaccagttttaacaacatcttcaactttatttactctgtcatatgctaattgagagatgtgaattaaaccttcaacatcaggaatgatttctgcaaaagcaccaaagcttgttgtgtttttaattgtagcagatactgtttgacctactgtataattttcaataaattcttgccatggttcttttgttaagtctttaacgcttaatttaactttgtagctttctttgtcaagttcggttacaatagcttttactgtatcgccaactttgtataaatcattaatgttgttaactcttttccaagcgatatcagaaatatgaataaatccgtctacgccgtctaaatcaatgaacataccaaagtttgtaatgtttttgattggagcttcaacaactttaccgatttctaaattagcaatagctgcgtctttagcttctttttctttagcttttctttctttgtaagcttcttcaagaagaattcttcttgaaacaataattttgtttttgtttttatcaaattctacgattctacattcaacttctttaccaagtaaattatcaaaatctttaatgaattttgtatcatagtaagaagcaggcatgaatgctttaatgaatcctaaatcaacaattaaaccgccttttacaacttttgtaattttagcgctaactgtttcttttgcttcaaatttatcttttgcttcatctaaagcactaagttcatcaactttgattttagataatgaaacgttccctgtaccgtcattcattctcataaccataactttaactttatcacctttagcggcttttgttgttaagtcttccataaggtcatataaataatcagcttttttaacaattccgtctgatttgtaaccaatattcattgttacttcattgtgatcgacagcaacgatttcgccttcaacgatgtctccctctctaatttctttcattgattcttcgatgtttttttcaaaactatccaccatgttgttgtccatagtattaattacctcctctattaactgggttggtgtagatgctccagccgttagtccaatattcttatatttctttatagcatcgtccaagtccgaagctttttcaacaaagaaaacatttttgcattttgatttactgatttcaaccaatttctttgtatttgagctatgagtatcaccaacaactaccatagcttcaacttctgatgctatcttactggcttcttcctgccttacgcttgtggcgttacatattgtattaaaaattaccacatctgcgcaattttctttaataatatctgttatatcattaaagattgatttaataattgtagtttgggcaacaatacaaacactgttatctgttttaaattctctcgcttcatctagtgagaaaataacatgagcagagttctcacaccacccgttaacccctataacttcgggatgatttttatctcctacaattattatagtataccctttattatgatatttttcaaccttattttgaatagattttacataaggacaagttgcatcaataagttttagattttttcccttaatcttatcatatacatcttttccaacgccgtgagaacgaattataaccgttccgctttctatactgtcaaggtcttcaattatatctacacctttttcctttaattcatttgtaacaaatgcattatgtattaaaggtccaagggtataaactttttcattcttgtttttacttgcttcataagccgtttcaacagctttatttacaccgaagcagtatcctgcactttttgcttttattatactcattttacatttcctttaatcttataatttcaggatagatttcttttttgcatatttctacaaaatcttcacttgtaagttttttaccgtaatatttgtctaaatatataggctttccgtaattaattataagaggttttctgaatttatattcgcctcttattccaacgggaacaactggaactttcattcttgttgccaaaagaacaagtccgccctttggttcaagcatttttttgtctgttttatttcttgttccttcagggaaaagccccaaaacttctttattctttaaaacttttattgcacttttaattgcaacaatatcattatcttctctttttacaggtattgcatatactttatgtaaaaaccagtttaaaaatttagatttaaataagacatccttagccataaaatgcagatgtcttcctttaatttgaacagctaaaaaaacaggatcccaaatatgaatatggttgcctgaaatgatatatgcaacatccttattaggaagattttcaagtcctgttactttaactttatataaaattttaaataaaaccttaattattggtcttaaaatatcatataacatacactacctactaaccgtttactttatttattatcaaatcaactacttcatttattgtcatatctgatgtatcaataacttttgcatcttcacaaataacaagaggatcaacttctctgtttttgtcgttttcatctctttgtcttatatcttctaaaatatcatcatatggaacttcttttcctctttcaatattttgaaggtatcttctctttgctcgttcttctgctgatgcatccatataaaacttaaattcagcatttggaagaacaacgcttccaatatctcttccgtccattatgacgcttttgccttttgaaatatctctttgaatatttaccattttttctcttacttcttttattgctgcatatttagaaacgtttttatctatattttcaaatcttatttcttttgttacatctttgccgtttacaaaaatataacctttatcgagaataagatcaatgctttctaaaagttttaaaatattttccttatcatcgctttcaacattattttcaagtgcataataagtaaaagctctatacatagaacctgtatcaagataagttatattaagtttttttgcgattatttttgctattgtacttttacctgaaccggcaggtccatctattgctatatttattattttattcattaataaacctcaaattctgataaatacttataaaatattatataatatctttttaattttaacaagtatttaattatattttaacgctaaaaagtttgtttatacctttgttaaattcatacttttcattaacaattggagattttatattatcagaaacctttaatacaagtacacttaatttatcttctttaaagtttctaagatccacttccacaacatctttatcgcttacggcaagagtcattatattattttttaaagtataattaaaatcttcttctccgtttacaagtatttttactccgtcactttcactaaaagacatttttataactccggcttctaaataattactggaatttaccagttttgtctgttcatttgaagtactgcttacagtggatattatttcgtttttatccaaaatattaagcccaatacataaaatacttaaaacaacaattaaacttactataaatttttcaaatttatatatcattttatcacctgtttcctctttaaaattttatgtcagcacttaaaaaaaatacttgtaaagttaataaataatttttatttttttgtttttggagaaaaaataaacgcaaaaaaatatccaaaaattattgctgcggtaattcctcctgccgtagccgtaagaggacctgttaatattccaataattccgtcttgttttacctgaagaatggttccttttaccagagaataaccaaaacctgttaaaggaactgtcgctcctgcctttccaaattgtactatgggttcatataatccaatagccgttaaaataacccccataactatatatattacaaggatctgtccggaaacaagctttgtattatccattataatttgtgctataagacaaagtatcccacctgttataaatacatttaaatattccataaaaactcctttaatatttattttcaatagatactgcatgtgcaatgcaaggaatattttccttttgtcccgtagagacaggacttaaaagagcacctgttgccacaagcaaaatattgtttaactctttttttaaaagtttatcgtatagaaaagaacaaaatacgcttgcactgcatcctgcaccgcttcctccgcttacaacatcttgattctttgtgtcgtatataagcattccgcagtctttgtatatattttctatatttactcctttttttcttaaaaagtccttggcgatattgtatcccacaatacccaaatcacctgtaattattaagtcgtaatcttgtggtgatttgtctatatcttctaaatgagtaataattgtatcacaagcggcaatagccattgcgcttcccatatcatttggatcattttgttcaaaatccataacttttcctattgtcatatgtgttattattggtttatttgttacatttttatttaacagtacacagccgctccccgtaacagttctttgagcagtgggcggagactgtgttccaagttccaaagggtatctatactgtctctctgccgttgaaaaatggcttgtagcacttattatagcagtatctataaagtcgccgtctaaaagcgttgaagctgtctgaagagcctctacaaaagtagaacatgcgttataaataccccagtaaggaatttttaaatctcttgcagtaagatttgtagttataatttgatttaataaatccccgcctatatagatatctatatcactttgttttaaattgttcttttccatcagtgcaagaatattttttaggcacatctgatgttctgctttttcataagaattctgcccgagtaaatcatccttaataatttcattaaaataacttcttaagggaccttctccttccattggtccaactatggctctggtatctgaaattgatattaaattatcaaatttataagtttgctttccaagttttttactcattatctacctcgttaaaataaaatatataagccctacgatagaacttgatgtaatcccaaatacaataacaggacctgcaattttaaacatatttgctgccattccaaaaatatatccttctttgctgtattccatggcacaagatacaacactattagcaaagcctgttattggaactatagaacctgctccggcttttttccctatattatcgtaaacacctatacccgttaaaaaagaaccgataaatacaagtgcaatagatgtcatatttgatgcttcagtcatagaaaatcctttcatagaaaaaaaatcatttattatttgtcctataatacaaataaatcctcctactaaaaatgacattattaaatgacttttcttaggctttggtttattttccttaactatttttttatattgttttatatttttttcgttggtttccatatctttctcccaaaaataaatttatttatatttttacccaaaaaaagaaaaactttcaaaaatttaattttcaaaagtttttttcatattttctattattttcttttctagtctagatacctgaacttgagaaagtcccaaaatttctgcaatttgtgtttgtgttttatttttaaaataccttaaaacaattatctgcctgtctcttttatttaaactcattattgcgtttttaagatcaagcctttctataatcatttcattattatctttttcatctttaattttatccataagtaagacttttgttttatctttgtttgtcagttctttattaagtgattcaggctgtctgcaagcttcaaaagccataattaaatcttcttttgatacacctattttttcacttaaataatttacatcaggttcttcaccatttaattttatatattcttctcttatttttcttgatttaagatatattgtttttaaatttcttgctacttttattattccttcatctctaaaataccttttatattctccgtttattacatacaccgcataagtagaaaactttgtacaaaaggaaaaatcaaatttctttattgctttaattagccctattgctcctatttgaaacaagtcttcatattgtacgttataagataaatatctttttaagattgaattaataagcggagtgtttattatggtaagttcttctaaagcatttttatcaccttgttgtgcatttattataagttcttttacttcatctgaaaaataatctatttttacagactcgttactcattttgatatgtatcctttgaagatatttttttgctcataattaaacttgtaccttctccatatatagattctatttcaagtgtatccataaagctttccataatagtaaatccaagcccagacctttcaagctccggttttgaagtgtaaagaggttcttttgcctttttaatatcctctatcccaattcctttatctattatttttattgttacttcattttcttttatatatgcttccattgttataaggttatctgatttattgttataaccatgtattatagaatttgtaacagcctctgaaacacttgtttttatatcgtttaattcttccattgatggatttagagacagaataaagcttgaaataataagccttgccaacgattcgttttctgatatgcttttaaactgaacctttaagtagttttctatgtttttacctgttttcatatttgtttattccttcctgtaaagttttaaataaatcgaaaattgaaagtattcccgacattctaagtattcttattatctgttcatctcttgtaacaataccgcattctccatttctcttctttatttgtctaaatctacccataaataaccctatacctgcagagtccataaatgtaactttgcttaaatcaaaaataaggtggtttatttcttttttgcataatacataatcaatattttctcttatatcatttgttacatgatcatctaaatctcccaaaatggaaacaataaggatattgtttcttattgttatttcaaagttcatatttatacctctcaatattattttcacctacaagatattatcaaaatcggaatgtagaaatttggaaaaaaagaataaaagtacatattaaaaatataaaaaaagcaggtatagcctgcttaaaataaaaatattaatataaactttatataatctaatatattatcattgaatcatttattagctatattaattataatcttttaaaaataagaatgtatatattcatttctttatataaatataattaatttataagattttctaatcctacctaaaatataatttttatatttaataaaaaaagacagatacaatgtatctgtcttttatatattatccttatagtattgcaagataaattacaaatataacaagtaatacccatgtaattgcattgatttcttttgctttacctgtaaatactttagatattgcatagaaaaggaaaccaacagcgataccatttgaaattgagtaagaaagaaccattgtaataattgttaagaatgcagcaacagcagttgcaatatcttcccattcaatttcttttaattgttgagccattaaaacaccaacgatgataagtggtgcacttgttactggagataagaataattctccaacttgaattgagttaacaacagttagaagtggcataaacaaaacggataaaaagaacaatacacctgttgtacaagcagttaaacccgttcttcctcctgcggcaacacctgaaccggattcaacaaatgatgtaaccgtagatgttcctaaaacggctccgacgcatgtaccgattgcatcagataataatgctttttcaacattttccatttctccgttttcatcaaccaaaccaattttattcccaaccgcaaccaacgtacctgccgtatcaaaaaagtcaatgaataaaaatgtaaaaataatcattataaatgacggtttggtaaacaaagtagataagccatcaaaacatccaccaaatgttggcattgcaaaatcaaaagaaacaataccttgaggtaatgacggcattccgctcacaccgaatatgccggcaacaacgcctacaactgccgtaataatcattccgtaaaatacagccgcattaacgcctttacaaagcaaagcaacggttatgattaaaccaaaacaagcaagaagtacggtaggatttgttaaatcaccaaatgcaatatatgtagatggatcagaaactattatacctgcatttttaaaacctataaaagcaataaaaaatccaatacctgcaccaatagccaatttcatatttttaggaatagaatttataattgcttttcttattcctgtaacagaaataatcaagaaaattatacctgaaatcaaaacagcagccaaagcttcttgccaagaatatccaaaagtcaaacaagccgtgtatgtaaagaaagcatttacacccatccccggtgctaaacctataggataatttgcaagtaaccccataattatacttgcaataccggaagagatagcagttgctaagaatacagattgaaaattcattcccgtttctgcaagcattccagggttaacacctaaaatataagccatagtaaggaaagtcgttaaacctgcaataagttcggttttaacatttgttcccttatcggttagtttaaatattttttcgaacattatgttcctccctaaaatttataaatactaatgagccaccattataacactttttcttcacctctacaatatgcttttttcacaaaagttgcaatttttttacattttttgattttttttgcaaaaaaaacagtgcacttgcactgttttcataaattatagtaaatccatagcaataagataaccgttaaggccttttcctattactctgtcagttgccacataagatacatatgaaagctttctgaactcttctctctcgcttatatcacttatatggacttcaattattttgcctttaaacatttttaacgcatcaagtatccctacggatgtatgagtataagctgcaggattaatgataatgtcatcaaattcatccagtgcttgttggatttttgttattatgcttccttcactgtttgattgatatatttcaacattatatcctagctctttcgcttttttatttataataccacaaagatactcataattttcactcccataaaaatccttttctcttcttccaagcatgttcaaatttggaccgttaattacaagaactttttttcccattcatatcaccttattttatttattttttatcaatgttttcatcgtctactgtttctttaagtgatgcaagaagacctgataagttttgaatttctgaaggaacaataatctttgttgctcttccttttgaaacttcgctgaatgtatccattgattttaaagcaagatattcttttgttgcttttgcttcgttaatcattctgataccttctgcatttgcttgttgaattctgataacagcttcagcgtccccttctgcaattttaattttactttgtttttctgcttcagcttgtaaaattgcagcttcttttgcagcctctgcactaagaattttagcttctttttcaccttctgctataagaattgcacttttcttttcaccttccgctctaagaatactttctcttctttctctttctgctttcatttgtttttccattgcgtcttgtatttctcttggcggtaaaatgtttttaagttcaactctgtttactttaattccccaagggtcagttgcttcatcaagaataactctaagttttgaatttacaacgtcacggcttgttaatgtttcatcaagttccatttcccctattatatttctaagagttgttgcagttaaaacttcaatagcttgaattggtctttcaactccgtaagtataaagtttagggtctgttatttgaaaataaacaacagtatcaatctgcattgttacgttatcttttgtaataaccggttgtggcgggaaatcaattacttgttcttttaaagaaactttctttgcaataacctcgataaaaggtattttaatatgaagtcccgtttgccatgttgtataatatgaaccaagtctttcaataacataagcataagactgagcaacgattttgacgtttgcaataagaagtgccataagcagaataataagtagtacaaataatataaaaccaaacatttttatccctcctttagtctatgttttttacaataagatgtacaccttctattttttcgactttaacctctttgttttcttttattatttcaccatttaaacttttcgctgaccaaacttgtccttttatctttacctgtcctactgcatccatattgtttatttcaactatcacaactccattttctccaattaaactgtttgcgtttaaatgaactatatccttttttatatatttatgatatagaggataagtgataagcagtaaaacaaccgaaacaataaaaaacactataacttgtgttacaatttgaaatccgctgaaatttaaaataagtgcaacaagacttcctccagcaaaccaaatagaaacaagctgagttgtagcaagttcaactacggtaaaggcaaccaaaagtataagccaaattaaaatcatgttttcgtttgtaatgttcatctttcttctcctttttgttattatatcatatttactttttaaatattattattaagtataaatttaataaatattttactttttattattgacttgttttaataaagatataaaaaaacgcctctaaattatagagacgttttaaatacagcttataaattattctaagttagcgtggtttttatacatttcagctccgtctgtatcaatatcttccattaaatctaaaataacagaatcacaaatcaataataaaccttgttcaaaaagtgttcccattggttgtattgattttccgctgtctgatttatcttttgcttgtgtttcaacttttacgatacagtctgcaacttctgcaataccttctttatcatttgaagaaataagagcaattttagctcccatttcttttgctttttttgccattgcaacaaggcttgatgttttacctgaacctgaacctaaaacaagtaaatcgccttctaaaatagcaggtgttgttgtttcacctacaacatatgttttatatcccatatgcataagtctcatggcaaaacctctcatcataaaaccgcttctgcccattcctgctgtaaaaattctgttagaattttcaattattgttttaaattcttcaacttgtttgtcatcaactttttccattaattcaactaattcatttgcaacttgttttcttttattcattatattcttcccaattccttccatgttttttccattctgtctttaacgtttgagtgtctgtcacttataaacatctcttgcattaattcagcgtcaagagcttgacaataaaatctgcatttacacaagaaaaagtaatatacattatacttacttcccgacataacttcaaagtttgccataccttttgaaattattatgtcagctttatcaagtacttcaatacactcttttgaacatttaggtaaatatgtacctacgatatcatttccgtttggaactatatccgcataatctgccattccggcttcgtatgcttctttaggtgtagcatcacttgaaataggataagatgcaggaacaacagtaatatgtttatcaggataaacttcttttaatttcttacataaaagagcatccaaaacaacttctccaacgttatcaagaagaataactatttcctttgcattttccaaatcttttgtaaaaatttcataaagttcttcatcgaacttatatttttttacatcgttaataatgctttttaaatcatcaagtgttaaattcggcattgtggcaaaatcaataacattacctgcgatggcaaatttaatggcgtcattgataacatcatcactttcgtttaacatactttcgatatcatctttcatatctaaaatacatttttggaatttttctctcgattctttatgaatatcgtctgttttcataaattttctcgttactctttcccaagccgattccaattcttgataagaagctgcatgcactgcctttgtaacttcttcaaaatatttttctcttttttcttcaggtatatgcttatttgcatattttgtgtatctccttcttgcacactcaagacaagctttacttgtagccatatttacccccttaaaaacaattcaaatatattttactacaaaaaattataaattaatagtattaaataaaaaaacacggcaataagccgtgctttttataacaagttattatttttctttcttatctgatttactgacagtatcctcttaatcttcttttttattattttcgtcttttgaactgtcaatatcttctatatcttctctttcttcatcatattcaatgatatcttcttttatcttactatcaagttcattttcagattgttcatcttgaatatcttcaatatcttcttctactgaagaatctatattatcagtacttgaaacttcttcttcctcttcttcatatgtttcccttgaagtttcagcatttgaactttctttgctgtctgaaatatcattttcttgattatcaataacttgctgttcttcttcaagctgttctacttcattagtgctttcatcatctgatgtattttctacttcttcacttgatatttcttcttcatctgaaactatattttcatctgattcttcaagctcttcttcgtaactttcatcatctgatgtattttctacttcttcacttgatacttcttcatctgaatctatatttttatctgattcttcaagctcttcttcgtaactttcatcatctaatgtattttctacttcttcacttgatacttcttctttattagatgatgtattttcattttcttcaacagcttcattttcagtgatatcttctataccttcatcattttctttaatgtcattttcttctgactcactttcatctgctgtgttggtttccttgttttcttctacatattcatcagtagtttcttctaaaacatcttcatgagcattttcattttcatctgaaacttcattatcttcagtattcaatttttgatcatcttgttcatcgattaaaggattttcctcttcataagaagtttcattattatcctcattttctaaagtagtgtcttgttcatcatgttttaaatcatcagaattttcttcttttgatatatcttcttttgttaaatcactttcttgtgtttcttctaaatcctcatcaaggacatcttttgtttcactatcaacttcttgagatatatcttcattttcatattgattttcttcttcgctgtttaaaacatcttcttcgttaatatctgcaatatcctcatctgtttcttctgtaatttctttaatggtttcttcaaactcattttcattatttatttcatcataaatagactctatttcttcttttgatacatcatctaaaataacatcatccaaagcttcatcggtattgtcaatattttcagtattatcattatcaaaaatatcttcaaaaatttcttcttcatttatagaagtattttcatctgtaatatcttcaatatcttctccaaactcttcaacattaaaagcttcatttttgcttgactgttcaaaagctaagtttagatttttatccctctttgcttcatataattcttcatcaacatcttcaaatacaaagctttcttcatcattgtcataatcttgatcaattaatgttgctttgcttacatgattttctgaattatttacaagttcaaagccgatttcttcttttacgtcgttttcattttcaaattcgtaaaattcgttttcgtctttaattctcgtcattgcggctacattaccgatattgacattttcgctttcttcttttttattttcttcactggaagattttatcttattatctaaatcttcttctatttctttataatctataatatttccgtttaattcaccattagaaacaatatctgccgtaccattttcttttggtacaattttgatatcctttaagcttggatataatttcatgatttgttctactgtaaatacattctctccgtcaacttcttcctcttcaccagcttcttcaataacaatttcgtcataatattcataatcgtcatcatggcttataggttccaacccaagagcccttttctttttaagttccttttctcttcttctacgttcttttctttgttctgctcttctttcagcttttaaatataatgtcattaaaagaacatacaaaatagcacataatattccaattagaataaacggtgtataatcaaagtcttcaagatttattgaatttatcgctttatcaaaaaagtcataatcatctatattttcttctcttaaagaattatcggtaaaaacgaaataatatacatccccatgatcaatggtaaacaaaatcattccgtgtccagttaaatcttctccatcagcaccggtaagctttgaattataatatatcttatatccgtttcttctgtctattttgcaattttcaacttttgttacggttggtgaagaggtgaatttctttgcaatgtttactgcattttgctgcatatatgaatcattgccatatgtgttttctaaaatatcactttttatattaatcttatcaggatctttgatgttatttttttcaagtacatcttcacctataaaatcttcaactttttcgacgtgaatttcaagtcttatttgatcttcataagggattgttacaacagacaaattactatccattacaacgttttttacatctttaggaatttttaaactatatagatatgttgtattataatattcctcataggaattaaacccaaataccggagtagaaaggtttgttattaatattaataatgtcataaaaaaagttaatattttctttttcatataattcctaccttattttcattccttttaatgatatcacaaaattaaacaaaataaaaggaatattatatactaacaaattataaaattattaattttttctttagtttttataaaaaaaacgtccgttttttggacgttttatttttttattggatggcgaattaccgtttttaaattatctatgttttttactcttcttggatcagataaatatatttcatggtgtaatctttcttttgaaaaatcgtttttatacccttctttttcaataaacgaattcattttttcaattgaaacaccctcatcatcataagaacccatatgcataatttgaacgcataagccttcttctatttccttaaaaaatgtatttgaaaaatcaacatcattatttttcttcttaaatttttctttagctcttccaaagacttcttttgtaacaaattcaggttgtcgtatcattgaataccaacataaatcatctttattcgttatatttaatccgtcaaaatactcatcttcaacccaccaaaaaccttcaagaggcggaacgacatattcaaaatatccatctattttatctaaaggatctttactcattttactcatctttattgtaaaagaaagaccataaagaatttccattgcatttttatattctattgaagtgtttggattacccttaccttttaccattataaaattcattttgggaacttctataatacttggagttttctttggcatatataaatctttatattcctttttataatcaagtttaaaatcacttttcatcagtacactccttataaaaattcatatctaagtttaaccttatcgcctctgaatattacttttgagtattcataaggctttttaaaggcatcatacattacatcttcaagaattaaaagaggatatccgcttcctgtttcaaaaattgcgcttacatcttcggtagaggtcattgattccaatgtttccaaaactttatttggttttatttcgtacttttcttctattaaaacacaaagctgtttactttccagttcatcacattcccatatttctttaaatttattataaggcaaatatgaatagtgaagacttataggttcaccttcggcaagacgaagcctttttataaatataacgtcatcattttcttttattcctaggtgagatgcaatgtttattcccgcttttattatttctttgtttagtagttttgttgttgtcttataccccattcgttcaagctgttctctaaaacccatgtatgcaagagatgtagtcattatttttgggtttgcaacaaaagtacctttccccgtaaccctatataaaacaccttctttgacaaggtgattacaggcatttcttacggtaattctacttaaatcatattctttcataagttctgcttctgacggaacttttgtatttactttccatattcctttttcaatattccctcttattaattcttcaagttgaagatacaaaggtttgggatcatttctatctataatgttattcataatgttcacctctcattataacccgttataaccagttattaattttaatataacataaaagataaataaaatcaaaatgcttattattttaaaaaagttaaattactcatcacttcccttttggtgcataaattcattaatgaatgctgccgttataattcctgacggcaaggctattattgcaataccgaaaaacgaagaaataatacttacaattcttcctaaaaaagtaacaggataaatatctccataacctattgttgtaagagcagaagttgcccaatatattgcttcaaaaaaattatcaaaagtacccggttcaacgttaaacataaaaaaagcagaaaacaatatatatccaaaggcaaaaaataaaatagaagttaatatatctttttctttttttactgcattaaatacgatttttatattttttgaatatctaaaacttctaagcaaagtacaagttttaaatattctaaacaacctaaacatctttaacgaatcatttaataagtacagtacaggaagcattgaaatcaaatcaattattgccaaaaatgtaaaaggataaagtataaacgataatttacctttttcaagcttataatctgcagttataaaccttaaaacataatctataaaaaatacaataaaacaaatgatatcaataacataaaaaactttattatttgttttaaaacataacggtatcattgaaagtattattactaaacacctaagttatatctaagccctgaagtattaacttctattcctttatcttttcttattagtaatagtaatatttcatctaatacttcactaaattcttcatattctattttctttttagaatatcccccatatcttactacataatcaatatgaccataaacatcaaactcattatataattttatattttcaagaacttcttcaaaatattttaaataagcttcttttctggataaaccactaaaaaaacttttatccattgccatatcttttttacaagtaatatgagatgagcctataacaaaatcaaaaggatattgctttaccattgtttcaactttatctacaatatctggctgtaatcctatttcaatgccaaaatttgtttttaatatagaatcatctttatattttaaatattcttttctatattctgacacatctaacatttttaattttgtatctaaacctgtataatcatcccaatgttcagtgaaagttatttcatcaacatttttttctttagaagtttcgatgtactctttgaatgtagatattccatcatgagacagattagtatgcacatgacaatctttcatataataagctctcctttaaaatatttattaaacttatatcctaaatataaagctacaaaataatatcatattatcaaattatttaaaatatcaaactttaatgtttatataaattttattattcaaataattttgcattgaaaatttttaagttgaaaagaatatttataaacacaaaataatttactgaaatattaaaaataagtttaattaaataccgcactttgaaatatttgaataaatatttataaaataaaaaaactgtaaaaccatttaggctttacagtaatatatctaagctggtgccgatggtgggattcgaacccacacgatattgctatcgacggattttgagtccgttgcgtctgccaatttcaccacatcggcaaaataccttatgtattatatcatcattgaccttgattttcaagtcctgaattatcatttttgccatttaaaatattatacataaccgctattaaaacaagtgcaccacctataaaagtcgttatacttgggatttcccctattacaagagcaacccaaattggatttaatattgcttctaacattgaaattaaggaagcatctacgctttccgttctttctatgccttttgagaataaagcataagatacacccatttggaatataccaagaataattattccaaacacccctgccatatcaagggtcggctgattattttgaagtaatgtcggtactgaaattaaaaatattaaaccattacctaaaattgtcgcatctaaagtatttgaatcttcgtatgaattaaaaataaatactcctgaatacccaatgcctgcaagaattgcaagaatgtttccaagcattgctcctgaacctactttttccataaagaatattattacacctataaatgcaagtataaccgtaaacacctgtttttttgtagggaaacttttaaagaatataattgataaaattataacgaatataggagccgtgtactgaagtattattgcatttgcggcagtggtaagttttgttgcgtacacaaataaaatgcccattgtaatatatgatatactggcgcatataacgtgtttatttattttaaaattcatgcttcctttaattaaaattaaagtaattgtagataaaaacgctctaaccccgcttattgccattgcatcccatggaatgtattttataagtacaccgtttaaactccataaaaaagcagccataacgatatatattgccccgtttttttgattgttcattataagcctccctttttttaaatactaaaatattatatcaaaatttttagaataattataattttttttatcatttatttttttatgtttttttggtaaaatataaaaaagacatatattaaaaggtagggaatttatgaagtacaaaaacataaatcctgttattcttattcctgcctacaaacccgataaaaaacttatcggagttgtaaaagaattaattgaacatgatgagaaaattctcattataaatgacggaagcggaaaagaatttgaggatatttttaaacaagtcgaggatttgggatgtacagttcttgttcacgaagaaaataaaggtaaaggaagagccttaaaaacgggatttgaatattgtattaaacataatttaagcgctgttaccgcagatgcagacggacagcatttaccaaaagatattttgaatatcgaaaaaatactcgatgaaaatcccgacaaacttattttgggcgttagacatttcgacaaaacaacacctcttagaagtttatttggaaatacagtaacaagaaagattttcaaatttttaaataacggagatgaaatagtagacacacaaacaggtcttagaggatttagtgttgaaatgcttaaaaaaataatagacattgaaggcgaaagatatgaatttgaaatgaatatcttgcttgagcttaagaatagacatattgaggttattcaagagccaataagcgttgtatacataaacgacaacgaatcttctcactacgatactttaagggattctttcagggtatataaaagaattataaaatatattctatcttctacatcttcgggaattttggattatttaagtttttgcctatttacttttatcggtatacccacaataaccgcaacatacattgcaaggcttatttcttccctgtttaattatactttaaacagaaagttcgtttttaaaaatgacggtcacgttggcaaaacaatgtttaaatactatgttttggtatttattgttgcaggacttagcggaatacttacaaagggcgtaaatatgtatcttggaataaacgtatattttgcaaaaattatagtcgatatgtgtttgtatattgtaagttacaatggtcaaaaatattttgtttttaaataatatcacattttaatttatgacataatataaaacagaaagaaggtattaaacatgagttttaaaatgtatggaatgaacagttgcatagattgtatcaatgcaaaaaaacttttaaaagaaaaaaacatcaattatgaacttattgaaataacagaagatacaacttcaatgaaagaatttttaaaactaagagataatcttaacgaatttgtaaaggtaagacaaagaagtacaataggagttcctttcttcgtttttgatgacggaaaaatgacttttgatgtagatgaagcaattgaacactataaaaaataaagggttatcccctttatttttttacaaaagatttcttacaatttaagactttctaaaacatctttaagtttagatgcagaattaaataaattttcctcttcccttttgcttagaggaatttccaaaactttatcaatccctttcatacaaactatacttggaatacttatacatatatcatttaaaccatactcaccgtcaatatagcttgaaacaggaagaatggaatgttcatcttttacaagagcagtacatattctttttactgccattgcaataccataataagtagcaccttttctttcaattatctcatatgcactgttttttacaccgctaaatatttcgttcattgcttgttcatgattaaaatgtcctctaagttcacagaagttatttattttcattcctcctatatctgaactatcccatacagcaagctcgctgtctccatgttctcctataacaaatgcatggatacttttactgtcaacatttaagtgtcttcccagcatatactgaaatcttgcactatcaagaaccgttccgcttcctattactctttttttatcgtatccggatagttttagagtaacataagttaaaatatcaacgggatttgaaacaacaagaagtattccttcaaaacttgtctttgtaatatttggaataatggacttatatattttaaaatttttatctatcaagtcaagtcttgtttcccctttttcttgatttgctcctgctgttataataactacataacaatcctttatatcatcatagtccccttcataaatattaatactttcacaaaaaggtatcccatgacttaaatccatagcctctccctttgctttttttctgtctttatctattaaaactatttcggaaaaaattccttcctgcattaaggaaaatgcaatacttgaaccaaccatgccaagaccaattatagctatcttttgtttgtttaacataataacctcctttctgtttatcttttgcatatagataaaaaatataaaaaaacacggtaaaaatttaccgtgttaaaacttaaaaagtttttattgaaaggattttattatctaaccttcatattttggcacaataccaacttccctcattaaatcaagagcatctataatcattggagcatcttgtgttcctataagttctgcgcctgccattaagtatgcataagcattttgaggttttggagcttttactcctgaaacttttaattttgtatttgttccttttaagcagtctctcattaatactgtttgttcaagagtaggtcctgcgtagtgtcctgtagatgatttaacataatcaattcctgtttcagcacaaagttcacaggctatttttatttcctcatcagtaagcatacaacattctattatcatttttgtaagtactccgcctgcagcattaacgtaatctttaaattcttgttttatttcatcgtattttttatctttcattgcccccacgttcatgcagttatcaagaacggtagctcccatttttacagcttcttcagcttcaaaagcttttacggcacttgtttgttgtccaagagggaaacctattccagcgcctacaagtaagtctgttccttgtagttcttctgcaactacttttgtccagtatgaagaagaaaagcaaaatgccttacaattatatttaattgcttctctacatcccattcttactttttcttccgttaaatcttttgcaaggctcgcataatcaaaaagcttacccacatcttttttggttagtttactaaaatctactgccattttattctccttttgtttatataagtttttttagtaattcgttgttaatgaaataatcataatcaattccgcattcacctataaatcttggattctcagaatcttttttatggtctccgtggaaatcagacccgcctgagattatttttactttatctttatatgtatttcttacttcgtttattatatcttcttttttcatgtttccggtgtagcttgttttatcgtaggtataacttgcttctataccgtctaaaccgtttttaataagattttctatatattcgcttcttgatacttcttttccatctaaaaccactttatcggctattaagtaaggatgagcaagaactattataccgcctgcatcatgaactatttttattatatctacaggatttggttttcttcttctgacatttaatctttcatcttttttagaaagtttctttgcgtcagaccatgtttttgtatagcctttatcagccattaagttaaaaataagtttcttttgaagctctttttcacttctctgctgtccgccgtaatttagaacttcatcaagagatatttcatatccacactcatttaatctatttaagaaatccttatagctttctattttgctgtttgctatatcttccattacttccttaatttttttatcctcaaagtcacagccatatgcaaccatgtgaacatcatcaacatcagtatcacatgaaaattcacaggcttttaataaatgtacacctttattttttgcatattctacactgtcaacttcttttccgtctacttctactgtttttggaggaagcatatcatggtcagaaatagttaaaactttcattcctgattttgctgccaaatcaataagttcctttggtgtgcaaagtccatccgaacgtgtagtgtgacaatgcatatcacataaataattaggtttaaaattataatcactcattgtttacgctcccctttctaagtgtaaagaaattgatgtgtttgtatgcaaggtcataaattttcttatatacataatcgtccaatgttaaaggattatgttcatctctatgagtagaagagtattcatacatactatcgcagtaagcgatttttattgctgttgaaatatttaccttacttgctcttaaatcaattaaagtattgaacatttcatcgcttaagcccgttccgccgtgaagaaccaaaggtacaggtgaaatggaatcaatttctttaaataaatcgtagtttaatcttatttctcctttatataccccgtgagccgtgccaactgcaggagcaaggaaatctacaccggtttcttttaagtatttttcgcagtcttctttatttgcataagcagcatcgtttgcatgaactactatatcatcttcaacacctacaatacttcctacttcaccttcaagagtaatatctctacctgctatataatctttaacaaccaaagtatcttctatgttctttttaagcggtgttttagaaccgtcaaacataatagaactccagcctgcatctatacattttttcgcatattcaatgtctgtgcagtgatccaaatgaatggcaacatcgacctttgccatttcacatataggtcttaagaaagaaataaattcttcaattccaaattgttttactgtttttaccgaagtttgtaaaataacaggtacgttcaaatcctctgcggcactcaccacagcctttgccgttaagtaatttactatgttaaacgctcctattgcataagagccttctcttgcgtcgtttaacatttttttcattgatacataagccatatttacgcctccttatataatatgtgctataaccacatataaccacttaataccagtatatgtataaagcccctttttgtcaatagtttttaatacatttaaccttttataaagagtatttttatagatattttatataacatattcattaagaaaagaatttattaaaattacaaataaataaaacatgaatttaatcttattaaaaatacatatttaaaacatatacaaataattcactaaattaaaaaaggaaacggaaaaccgtttcctttttatattaatcaaaatgattaagtcttactatttcatagagttttcgtaagattcaaccattcttttaaccatttcaccaccgattgaaccggcttctttgctagttaagttaccattatatccttctttaaggttaatgctaagttcactggcaacttgttttttaaattggtctaagccttttttagcttcttttttagtcattttttttcacctccatttataagtgttatacttatattatggacgtaatattttaaaatacactggtaagttattccttgtttattcaaatttaaaaaggcttctttttcttgaattttttaatgtattatatttttcttttaaaattgaattttcgtaagtcttttcttttaatttcattttaagccttgcattttctgcaataagttcatctctttgtttaaagttatcctgtttttttaattcttctatttcttctcttagagaatttatcgtctttataaggcaggttatgttattttcttcttctttcggtttttcttcttcaatctcttcaaaaataattttatttttgctttccgataaagtttctttaatttctttgtttttctttccctcgtctttaagagattctatgtaacggaaaatatctatttcccttgttgtataatatcttctgttgtttgaacttcttggaatttcaagaccgaactcatcttcataaaatcttagtaaataaggcttacaatttaaaatatttgatgcttgtgtaatagtatatttcaaaacttaactccttaaacggtttttatatatattactccaaataatttaaaaaataagccttaatttgtcgtttattcagttttatttttataatttaataatttcaatattttctactgcttcatctatcaaatcatcaatatcaagttttgcttcttcttccaaaactctctcaagtttaggtttaattataggatgttttggaacgaatattgtacaacagtcttcatatggtcttattgaaatatcataagcaccgatttttcttgatatatccactatttcagttttatcaaaagcaattaatggtcttaaaataggtaagtctgagcaagcatttgtacaagaaattccttcaatagtttgagatgcaacttgtccaaggctttcacctgttataagagcttttaaatcgaatttatcttttaatctgttagcaattttaatcatatatcttctaagaattacggttaaatattcgccttcacagttttttataattgcttcttgaatttttgtaagagaaacatttacaagagttatacccatgttataatcgcttaaaacttctgcaagatctttaaccttttcttttgcgtccatgcttgtaaatggatagctgtgaaaatgaagtcctacaactttcatacctcttttattcattaagtatcctgcaacaggagaatcaagtccacctgataaaagaagtccgcctactccgctgctgtttacaggaagtccagcattacatcttatatctcctgcataaacatatgcattttctcttatttcaacttttaaaattgtatcaggattttttacgtcaacctttaaatcatctgtattgataagtacataagcccctacatctttacttatttcaggagatttcatagggaattttttatcgcttctttttgtttctactttaaaagttttgtaattcccctctttcattactttaagagctacttctttaattttgttcatatccttttcaagttcgtaacactttgtaagatatacaatcccaaatactttcttaagcctttctataatggcctcttcatcagtttcattatatccgcttactataattctgctttgaattgtatgcagtttaacattctcaaattttcttagagaaagtctaatgtttttttgaagtaaatctataaagaattttctgttaagacctttaagacttatttctccatattttaccattattattttattcatatattttctacctactcattttatttaaaagatgtaatctttctaagttttcttttaattttgtaataaaaacatcaatttgttcttttgtattaaattcactaaaacttattcttatagttccgtttattaaatcatcatcaacgtctattgcctttaatatgctatttactgttgtgtttcttgaagaacaggcacttgaaacggaaacataaatattatcttcttcaagcatatgaagaagtacttctccttttatacctttaaaacttacatttaaaatatgataagaaatatcggctttttcataaggagtattaatatgataatctttaatctcagaagatagtttacttaccgtatataaaaacaaatccttaaaaatctttttattttcttcaaagtttttctttgtaattttaactgcttcgtctaagcctgcaattaaaggagtgtttattgttccgcttctgtaactttcctgttgtccgcctccgtgaagaagtggaagaagagttatattttcctttaatactaaagctcctattccctttggaccatggaatttatgagcacttaaggaaatcatatcagcatcttttagttttaaatcaacttttccaacagcttgagttgcgtctatgtgaacaagaacattttcgtttttttcttttactttttttattattttttcaacatcctgaacaacgccaaattcgttgtttacataaattatgcttataagttttgtattcttatcaatactgtttactaattcttctaaatttattacaccatttttatcaactggaacatattttgtttttacattcaaatcttcataataatgaaatacatttgtaacacaaggatgttcgatattggttgtaataatattgatgttttcgggatgtttgatttttcctattgttcctttaatggccatatttacactttccgttgcaccggatgtaaaaatgactcttctattttcttttatgtttaaaaaatcaagtaagttatcttttgtttcttttaatattttaccggcttcaaacccttttttatgaacggctgatgcatttgcatagtcatataaaagatatttttctattttttttgccgcttctttataacacatggttgtggcggcgttatccaaatatatttcttccatttagtctataaactccttaacaacatattttgaagtaaaggctctaagtgtagcggtataatacataaaaagttcaaatgtatcaccgattttataatcatttttactgtctgtgatatctataattaaatgatcgctgcttcctccaaggatttttgtatttgtatcaagaggaaacatatcaaggtctatatcctgttttcctacagataaaatcgctctttttcttataccttcatcaacaaattcaggttttgaatttaaggctgaaaaacctcttttgcctattggaattgaaggtttattttttatttctattatctcggcttttaatatgaaagcgtcttttatcataccgtcaatatggcttctgtaagtacagtctctaccaaaataaatagtatcaccgactcttatattggttattccttcaatagggttatcttctctaaataaagtatagcttgttgaatttccgcctgaaaccacttcaagcttttggtttaactcactttcaagaagtttgtttacattcacaagatgagttagatttttttcatcaggcaaaactcccccgtaacaggttaagtttgtagctataccctttatattaatattggaaagatttttcatttttttagcattttcaacgatgtctttttcttcaaaatatccttcccttaaatcgcccacatcaaacattaataatatatcgtgagttttgttttgatattttgcagcctcgtttaatgcttttaccgtatcatattcactgtttaaggatacatcgctgtattttacgacttcatctgccattgaaatgcttggaagtcttataagccatttttcagcatctaaatccttaatattttcaagattttctattcttgaatccccaaacttctttattcctgcttccattaatgttttaactattctttcattgcaggaatgaagtttcgtaacagctgttacatctacaccgtattttccaagagtttctttaacggttattgcattatcatgtattttgtttaaattaatctttaatgtaggtctcatacttttcccttctttagtttttgaatgaatgtacaggagatggaattcttccccctctttgaatgaaatcagaactgctgaagctgtttacttccataataggtgcacttccgaaaagtccgccccagtcaactttatcgccgactttcttaccatatacaggaactactctaacagcagttgttttattgtttattacaccaattgcagcttcatcggcaatcatagctgaaattgtatcttcaggtgtttcccatggaattgcaatcatgtcaagtccaacagagcaaacgcttgtcattgcttcaagtttatcaaaatgtaagcagccgtcttcaactgcagcaatcattctgttgtcctcacttacaggaataaaagctccgcttaatcctccaacgtgacttgatgccatgataccgccttttttaactgcgtctgtaagcattgcaagagcagctgtacttccgtgagcaccgcatctttcaagtcccattacttcaagaatttcagcaacactgtctcctattgcaggtgttggagcaagagacaagtctaaaattccgaaaggaacatcaagtcttctgcttacttcgtgtcctattaaagaaccggctcttgttattttaaatgctgttctttttattgtttcagcaatttcgtcaactgttgcacctttcattccttcaagtgcagttttaacaacaccaggaccgcttacaccgacgtttataactttttcagcttctcctacaccatgaaaagctcctgccataaatggattatcttcaacggcatttgcaaatactacaaattttgcacaaccgaatgagttattatcctttgtcatgtatgcagtctttttaattataggacccattttcttaacagcattaaagtttattcctgattttgtacttccaaggtttacacttgaacacatatttgttgtttctgttagggcatatggaattgattcaaggaatgaaacatcgcttgttgtacatcctttttgaacaagagcagaatacccgccgataatatcaacgccaacttctttagcggcattgtcaagtgcttttgcatactcaacccactcttcaacgctgtttgcacaagcaagagctattggagttacggaaattcttttgtttacaattggaataccatattcatcggcaacagtatccgcagtttttaccaagtcttttgcaattgttgttattttatcgtaaattttatttgttgcaactttataatttctgtcaaaacaatcaagcaaagaaataccaagagtagttgttctgatatccaaattttcggtatcaagcatcttgattgtatccattacatcttttttttgtataatcattgttttactccttaaattttatgcattgtatcaaatatttcttctttttgaattcttattgataaaccaatttcttcagataatttatcaagttcttccttaattgttttaaaagaagctttattttcgtttattttaacaagcattaacattgtaaaataatcttgcataactgtttgagaaatatcttcaatgtttacatcatagtcgtttaatacttttgaaacattataaataatccctgttttatctttcccgattactgtgataattgctttcatatcttcctccgatttaataaaaatatttttaaacttaaattatatattatcatatttacctttataattaaacccttgtttgatataatttggtgaagcggaggttaaaaaatgaaagtaaaatatttatataacagcggatttttaattgaacttgatgattatatttttgtaattgattccatgaacaaattaaaaattgaaagtaaagataaaaaagtaatttgctttgccactcattcccatatggatcactttaacgattttattctaaaagaaggattatgtgttttaagcgatgatataaaagtaagggaaaaagataatattatatttataaagccttatgatgaaattgaaacaaatggaataaaaataaaaacatttggttcaacagaccttggggtaagttttttaataaaagcagaaggaaaaatattcttccacagcggagatttaaactggtggcactgggaaaatgatgataaaaaaacacaggaaaaagaagctaaagactatcaagatgaaataatgaagttaaaagaatatttacaaaatgaatttattgattatgcatttattccggtggacagaagattaaatgaaaactcaacacttgccattgactttttcttaaaagaaattaaaacaaaagatgttttccctatgcattttagagaagatttaagatatattgaggatttaaaagaaatagaagaaaaatataaaaatgtaaatattcatgaaatcacaaaagaaaatcaagaatttatattttaaaactatatataatattttgattaatattaataaattaaataataaaatatgtaatattaacattaatttttaaataattatgtaatactatttaatataatataataaaaaaaatattagttaaacaaaaaaagaaacgcaatgcgtttctttttatttttctctaccaaccatttctatttcaagttcatatttacttccaacgatttttgaatggtctatacatataggtttttgtcccatataacatgttcttttaagttcgattaaagctgttccaaccgcaacatcaagcatttgactttcttcaaaagttgcgttctttgcagaaattaattctgttgcagaatcgaagtttattccatattccctttcaaggaatgcatataaagatgtaatttcatcttgctttttaatgatatccggaacatcttcttttcttaaataattttttactattgctattggaatattgtttgcaagctgtattctttgaattcttattattacagttccgttttctatgccaagtttttcacttataaaatcatccgcagcaacggaatctataaatatatttttaggtttaacttcataacctttatgtcgtaatgtttcagaaacagacgttacatgatttaaactttgcattgttttattgtctgttacaaccgttcctttaccttgttgagcttttaaaaatccttctcttgaaagtaggtcaacagcttttcttacggtagttctgcttacaccaaacatcttttctatttcaggttccggaggtattaagtctcccggcttataatatccgttttctattttttctttaaaatatttgtaaagtttgctgtattgatatactttttccatatttcatacctcctattatcaatattttaatataaaaacgtacttaaatcaacaaaaaagatacaaaacatcattatcactatgattttcataaaaaaagacgtgccttttgcacgtcttttaagcatactgtccaatgtcaagtctcattttatccgcaaccattgcaataaattccgaattggtaggtttacctttattttggtctattgtataaccaaatattttatctattgtctcaactcttcctctattccaagcaacttctattgcatgtcttattgctctttcaactctacttggtgttgtaccgtatttttctgcaatcataggatataaagtttttgttattcctccaagtaattcaacattatcaataacaagttttattgcttctcttaaataaatatatccttttatatgagcaggaacacctacttcatgaagtattgatgttaccataacttgataatctttatctttcttttctttttcttcctttgcttcttcgttcatatcgggagaaaaatatgcatctatctctctcgttaattcatcaaaattaaaaggttttaagaaataataatcagctcctaaatttactgtttgtcttgtaaaagattctcctccaacagctgacatcataacaacatgagggtcgtagttacccatatcacttttatttaatttttcaagtacaccgataccgtctagcattggcattatcgtatccaaaagtaaaatatccggcttttcgttttcaacaacatccaaaaggtcattgccgtttcctaccacccccactacattaaaattttctcttccttcaaaatggtcttttacagccaaagcaaatttttcgttatcatctgcaattgcaactttatataccataatttttcctcccgatttaatattattttgttttattttaatttcttttaaagattactacaattttaatgcaaagtttgtctaattttgctcggttaacaaatcttctaaaagccattcaatataaattccatatcctttggttgggtctgttacaaatacatgggtaacagctccgacgattttgccgttttgaattatgggactaccactcattccttgtacaataccgcctgtttttgaaagaagttctttatcggtaacctcgattaacatacttttggtgtttttcttggtttgtttataggtctttttaatttttatgtcgaaaagtttcggaccttcattatcaatagtagttaaaatctgagcatcgccctcttttattttatcttgaagggcaatttccattggagaagatgaagaattaactttctttgtaacatcaccgtaaattccaaaatcattattaagttcaattgaaccgattatgtctttgttatctgcttttaaaactcctctaagctctccgggattgtttctttttccttttacaatgcttataagttcgctttcaatcaaatctccgttttttacgggcattattattcctgtatcaacatcatttatgctatgccccaaagcaacgaatctatttaacttatcattgtagcaagtaagcgttcctatccctgcaacgctgtctcttacccataagcctattttatatttattatcgtcttttgcttttacaggttttactgttactgtctgctcaacattttctctttttattacaacttcaatttccttatggtcgattttgtttaactgctcgataacttcatcggcattataaaccttactatctcctatttcgactattatatcccctgtttttatccctgcatcttttgcaggacaaacttcattaccgctaatatctataaaggattgaaactgaacggcaatggctcctttggtattcatactaaccccaacaagctgtcctgacggataaagctttgtgtttggtataacgtttatgttatagttatttattggtatgattccaaaaagttttgcctttagtttatattcgcccgccgaagatgaataaacttctattttattatcttcaacatcactttttgaagaagttgtcccatttacttttaaatcttcgctttcattttcaattttacagttttttggcaaatctaaagaaacactggttgtctgagaggataacacagcaatctctttagtatttatatttaagtaagataggtaaactgaaaatataaaaattatagttaaaaatcctaaaagtaatttttttcttgaaaatatattcacacttagtacctcgtttgtttttttgatttattgttcccaatattacaaaaaatataaacgaagcacaaaagtgattattgattttttaatttgtcagcattttcaatcatgtcttttgcgtacatgattgcattttcactggtgttttcaccgcttattattcttacaagttcctctactttttcttcctcattaagttttgtgaaagatgtaaatgtcttatcatcttttacttcttttttaatgaaataattcgtatctgccattgaagcaatttgaggaagatgcgttattgcaagaatttggtggttttttgaaagttcccacatttgttttcctacgattaaagcagtttgtccgcttattcccgtatctatttcatcaaatatcaaacaatcaacattatcattttccgataaaattctcttaaatgataacattactcttgaaatttcaccgcctgatgctattttattcagtggttttaaactttctcctttatttgttgaaatcatgaaagctatatcatcaattccttttttagtatagttttcattcttttcaaggtctttaaattcacaggcaaaaaccgttcctttcattgaaagaagctgaagattttctgttatttttttacaaaactcatctgcaattttttttcttttatctcttaaggtttttgcgtgttttaaatattcttttttctttttatccacgtcttttttaagagaatttagagtatcttcatagttatctataagctcgatattattttgtagttcctttttatattctaaaatttcttctattgttactccatatttctttttaagataatttatcttatttaatttactttctatatcgtttaattcttcggggttaaatgaaatattatctctgtaatcccttaagaaaaacactacctcttctattaatgtatttgcctcgtttagcatttctacattttcttttacgctttcatcataatcaagaacctttgaaaaagaatcgtttgccaaggttaaatttgataaaacgttactgtctgatttatataaaagagagtatgcactgtctatatctgaatatatattttgtgaatttagaagaattttttctcttttttcaagctcttcatcttctcctatttcaaggtctacttcatttatttcttcaaattgtcttttaaaattatctaaattatcactgttttcctttgattttttttcaagttcagtaagttcttttaaagcctttttatattcatcataagataaagaaaccttgtttagatcttcttttattttattttgtccatatgaatcaagaaaacttaaatgagtattttggtttaggagtttttgatgttcatgttgtccgtgaatatcaataaggtgagttccaacttcttttagagttgatacattaaccaatgttgaattgatcttgcatatatttcttccttttaatgaaatctctcttgttaaaataagtgtttgatcgctatagtcaatagataaatcatcaaggacttcctttaattcatgattgttttcttcaacagtaaacaaagcctgaataacggctttatcttttcccgttcttatgttttccgtttttgcatgttccccaagaaccagcgataaagcaccaataattatggactttccagcccccgtttcacctgttattatgtttaaaccttcatcaaattcaatacttaaattatctataattgcataattgtttatattaagcgataaaagcattttattttcctttctttaagagagattcaaactttttaaccaattcttttgcgtcatcttcacttcttacaagtatgaaaagtgtatcatctcccgcaaccgttcctacaatttcatttaattttaaagcatcaattgcaacacctgcagcttgagccattcctgttattgtatgaaggcatacaaagttgtttgcataatcaattgttaaaacagcttctctaaaaacacttacaattctgtcatctaaatttgaactttgatttgaatatgcagcatatttatatttaccgctttttgtcattacctttattagtttcatctgtctgatgtctctcgaaactgttgcctgggttacgtttattccagcttcttttaaatattttgttaagtcttcttgtgtttcaacttcgtatttgtttagtatttcaagtatttttgaatgtctgtcaatcttcatgaacaaattctccttctactattgggttttttatcttgtttacaagtaaagaatagaaattataatcatcaaatcttatgaaattggctttaagtgaacttttctttactattatttcatttccttttatatcaggttcaacactgtcgatataaacactcgttattttagggttaaatcttatttttacaacatcatttgaattaacgataatgcttgttgaatttaaagtatgagcacaaataggatttattataaacaaatcgcagtttggatttacaactggacctccacttgaaagattataagcagttgaacctgtaggtcctgctataattacgccatcagcaagatagtcagcaaaaacttcatcgtttataaacaccttatattctgcaactccatagtggtttttcctaaataaaacagtatcatttaaggcaaaaccaagtttattattatctttgtcatacacatcaagaagcattcttttatctagtgtatattcaccatttaacgccttatctatgcattccatccattcgtttctttctacatttgcaagaaaaccgacttttccaaagttaattccaagaatgggtttttcgtattctcctatttgagataaggcttttaaaattgttccgtctcctccaattattataataaaggaaactttttttatattttcttcgtttaatattgaaaagctgtcatattcgggatttttcaatggttcttcaagatacatatgtacattttttccatacagataatgaactatttgtcttgtgaaatccatgtatctgtcttttttataatttgttattattcctacatatttttccataatgtcagtcaatctccttatgcgcattttcaacacattcatctactatattatcaatatctataaggttttcttcattttttgttacatatgcaataaattctctgttgcctttaggtccttttataggtgaaaaatcaagtttttcaacatataatcccttttctttaagccccaaaatcacatctttaacaacttttttatgaatgtttttatcttttattattccattcccaacaagttctcttcccgcttcaaactgtggttttataaggcatatatatactccgtcgtcttttaagaaattaagcagattatctgcaagttttaaaattgaaataaatgatacgtccataacggcaatatcaatcatttccccaactttatcaaattccatatttctgaaattcgttttttcaagacaaacaactctttcgtcttgtcttaatttataggcaaactgcccgtatccaacgtctatgctgtatactttttttgctccgttttgaagcagacagtctgtaaagcctccgcttgacgctcctacatccatacaaatcttatctttaacatcaacatcaaaaactttgattgctttatcaagtttgaaaccgcctctgcttacaaagggattatcatttccttttataataatatttgaataaatatccacctttgttcccgctttatcgactctttggtcgtttacaaaaacaagaccagccattataagcctctttgccttttctctgctttctgccattccgctttcaaaaagcaaaacatctaatctttctttggttttcatttttttatcctccctttaatagagaaaaattccacaaaaaccgccgcttttcttactatctcggtggagttgttcattgaaatgtgttttccaaaggcttttcccccaactgtcaaagcagcgacaacaccgtttaaaacaacacttattataacggtttcttttaaattatatatactagcgatttttactataattattgcaacggtggcaccacttatgataccgcatatatctccgataacgtcattacatatatttgaaacctgagaagcttttttaacaaggtcaacagcctttcttgctcctttaactttatttgctgccattgcattaaaaggtgcaaccccctctgtcgttaccgcagttccaaccatatcgcatattatacctatcaatattattgcaaaaagcacaaagagtgcaccaaccaagcccgcattccccacaagagattcgcttattacgttaaaggccatagataaaaagaatgttaaaaacgtaatttttatagcccagctttttccgtcttgttttttattctttgacatatttcctccgatttctactaattatatcacaaaatatttttatttttttaccattataaaactcgacaattttttatcaaaaattcgtcaatttttattaataatatccgtttcttttactatcttcgctatcggcaattctctctaagctatttgatattgattttatatccttaaaatattcttctatttttatttttaaataccctaaaaatgatattaccgaaacaagtaccatgaataataaaacaggatttattatatttattattttagtcaaataatccaaaaaactattcatatttattctctccatgttataaaaatacaattatatcatatactaaaattaaaaaaaaagaaaggttttaattatgttaatttgttttattcgtgttgcacttatatattttttggttttattcgccataagatttttaggaaaaagacagataagcgaatatcagccttttgaacttgtaataacaataatgatagcggatattgtaactgaacctatcggcgacgttaatattccccttttaaacggaataattcctcttattgttttaatatttcttcaaacctgtatatctcttctaacatttaaaaacgaaagaataaggacttttatatgcggtaaaccagaatatcttatatataacggcaagataatgcaaaagcaaatgtcaaagatgctaataggcattgatgatttatgcgaacaattaagaaacaatgatattctcgacttaaacgaggtttcttatttgattttagaagctaacggaaatcccagttttgtagacaaacaagaaggttcacttccaataagcctcattaagtatggtaaaagactgagtaaaagtcttcctcttgcaaattataccgatgaaaggcttgataaggaacttagaaaaaataacatcgtgaatgataaggatgtcttttgggcatacgtataccaaaatcagttatatataataagaaaggatagtttaaaatgagatctttttgttttgcggcggcacttttgattacacttcttgggataaatgtttactgttataactttataaaagagtcatcaataaaacttgaaaacaatattgacgagatagtttattacttaaacaaaaatgatgatgaaaatgtagagaaaagttttaatgagttaaaagaacaaacaatagaaagtaaaaaagtatggtttcttataataaatcacgaagaaattgataacgtagatgtaaagataaaggaatgtgaaggatatataaaaaaagaagccgacaatgaattattggcctctttaaattctcttaaattttatataaacaatatctacgaaagggaaaaagtcaacatccctaacattttttaatgtgatattcgttgcttttttcttttaaaattcttccttctcttaaaagctgttccattttatccatgtcttcactttcaagagcttctttatattcttctaatttttctattatattttcaacctcgaataaaagggcatctttattcatgataaaaagttcgctccacatatattcgtttaactttgcaactcttgttaaatcaagaaaacttcccgcagaaaagcctttctcttccaaaattgaagggctttttacatatgcgtttgaaacaacgtgtgcaagctgagatgtaaaagcgattatcttatcgtgttctcttggagttgataaaacacattctttaaacttcatttgtttcacaagctgttttataatatttatcttatctttatttgtattttccgttacggtaacaataaaacttgcccctttaaataaatctgaaacagccgcatcgtatccccaaagttctcttcctgccataggatgagctccaacataatctatatttctttttatcgcttcaggttcaattttatttactatctgctctttaaccccgcataagtccataagggtagaatgttctttcattgtttccattactttaaaagcaaggttaatagtattaacaggatgaagagctattacaaccatatccatttctttcatatcatcaattaaaataatatcgtcaattgctccgtccctttttgccttaaccaacgtttcagagtctatatcataaccgaaaactttatttgtcgtatatttctttattgcttttgcaaaagaggctcctataagcccaagtcccactactgctatgttcatgttatcactccttaaaaaatttgaagaaaacttttaaatatgtcagcccctgcaataatcgttcctattgtacttccaagattagcaaaggtaactaccaaaagtatttttgttattctgtttttccaaagtccctttaaactctctaaatcagaacttaagttttcaaaatcggaaacttttggttttcttatatatgcttccacaagccctgcaaaccaccctgccgcaagaagcggattaagggaagttattggagcagctaaaaatgccgttataatggctggaatacttccaaaagcaaggactacgccaagagcacttaatgttccattaaaaagtatccaacttattatttgagaaaatcccgtatcagcgcttttaaaaaagctgaatattatcattaagataataaatgccggaattccaaagcctataacttttcccgtttttccgggttttggtatttcttctatttcctttaaatctatgtcttcttgtatattttttattattccgtttaaatgagccgcacctacaacggcaactattttttcgcattttgcgttttttatcttttgagaaagatatatgtcacgttcatctacaaggtatttttttaaatccggaaatgatgtgcttatatcaagcaacgcattttctatataatccccttgttttatattttcaagatcctcttcgcttaattcttcatcttcaaaaaagctcataataagaccatacagaagtttcatcttttccataaaagacatcttcctgaatattctaagaaaagttgtcttaatatctctatctgctaaagtaagctttgctcctatttcttcggcagtatttattgcatttatcatttcctgccctgagttaatatcaaaactttcggcaattcttttttgataagaacttaaaataaggtttatcaaaagaagagtcgttttcttttccttaataacatttacgatgtccgtatcctgccatctttcattatttttaattgaagaatatctaccctcatcaagctctatacagacattatcgggctttatttctcttatcatttcttcaacttgaatggcactttctcttgatacgtgtgccgtacctataagggtaatttctttaccgtttatattaagctgtttaactgtttcagacattttgcctccgtaaaataattacaaattacccccttaaaaaagggggtaatttattttatcattttttatttaatttataaagcatatttaaaaaattttagctgcaacctgttgttgaaccgcagtctgcacatactttacatgttccgtttctaaaaagtctgtttgatgaacaaaccggacaaacctctccgtacactcttgttgtatttgggtcgtcttttatctgttcatagctaagctgttctttttcttgtctttcttcttttattattttattgcttatgctgtcgtttatttcttcttcttgtggtttttccggttttacttcaactcttgtaaaatccccaagttctatatctattatcttacttaataaatcagcaatacttgaagcatttttaatgtaaggatgtcttgatacaaatccgcttggttcaaattgttgacctcttagaagtcttgaaatttcctttgcaggaatgttgtattgaagcatatttgatattgattttgaaagagaagcaagcagtccttttactactgttccttctttgtctgttgaaacaaatatttcagacattcttccgtcttggtagaatcctattgttacatataattcaatatcacctatcttagcagcatgagttctgcttcttctcattccgtcaggtttaattctgtgaagtgttcctctcttacagtgttttgcataatcaagaagtccttgatatgtaaggtcttccaaagaatcgctttcactttttattgatgtattaagaggttgagatgcctttgaaccatctctgtaaacagaaatagctttaacccctgacatataagaaagtttatatatatcgcttatgtcttcataagttgcgttagaaggcatgtttactgtttttgataaagaaccgcttataagaggagttactgccgctaccattaaaacatgtccgcttggagaaatttcgtttgcagtttcaaatattttcttatcctcttctcttaagtgtggtgcatcatttaatgaatagtgcataaagtttcctatttcatctttttcaagaagataatctttaatatcttttatttcttcttctttatatcctaaatttctaagagcaatttccaatattggatttacaagttccattgttcccccacctgaaagggatttataaacaacgtttgaatagaaaggctcaagtgatgttgcaccgcagtccatggcaaatgaaattgttcctgttggagcaataacagttgtttgagcatttctgattccatatgcttcggcatgttcaagagcttttgtccataaaattctgcttgcatttaaaacttcttcaagtcccatttcagaaattacatcttcatcaagttttaaaggaacataatcaagcccttcaaaattatcatctaaagcaagagaacatcttgcagagtttctaagtactcttaacacatactcagcattaatatcaaatttttcaaatggtccgacacttcttgccattaaagcagaaacaagataagattgtgcggtcataatagagcataatgctgcagttaagtttcttccttcgtcgctgtcgtatgggtaaccgaataccataagaagagaagccatatttgcaagtccaaggcctgttgttctaaacatataactctttcttgctatttcttcagttgggaattgtccccaatgaattgatgcttcaagaacaagttgtattaaagaaatcaaatgaatataatcatttaatttaaaaattccttcttcttcgttatagaatctgtaaatattgattgacgcaaggttacaagcagtattatcaaggaaagcatactcactgcatgggtttgttgcgtttattctgttgtattttgcacctacgtttccgtcttcacctgcagggcaagtatgccaagcattgaaaacatcatcaaattgaaccgcagggtctgcacagttccatgctgatttacaaattaaatcccataagtcttttactttaacttccttatttacttcttcatcaactcttcctttaagttcaaaagtagcatcaggattttctcttaagtttaagactttttccataaattctctatttagtcttacagagttatttccattttgtccgcttactgtttgatatgcttcaccgtccattgaagtatcatatcccattttgccaagagctcttactttatcttcttctcttgctttccaagaaataaaatcttcaatttcaggatggtcaatatcggctataaccatttttgcagctcttcttgttgttccaccgctttttattgctccggcatttctgtcaaaaccttttaaaaagctcatcataccagaagattttccgccgcttgaaagtttttcgtttaatgctcttagattagaaaagttagttcctacccctgaaccgcctttaaataactttgtttctgtaacgtattgttcagaaatagaattatcaccaagcaatgtatcttttatagaaagaataaagcaggctgaggcttgtgttcttgtgtatctgtctttactcttctttacgcttctgctttcagggtcaaagtagaacatattgtcactttcaccgcttatgccatagtttctctttattcctgtgttaaaccattgtggagagtttggagcccacatttgatttaaaagagcataagctacttcatcataaaaaatattatattgattttgagttgttataagcccttcatcaacaagagcatctgcccaaaatcctaccattctgtccactacttgctttatgcttgtttcgtgtccgttatcttttcctacccctgcttttctaaaatattttgatgctatgatattacatgcattttttgaataaaattcagggaattccaaatcgtgcatttcaaaaatatttttttgagttttataatcaaaaatctcaacatctacggttttatattcaaataaatcataaaccgtaatgctgctatcttcttcaagtcttttggtaaaacgtcttttgaaaatattgtttacacttaaattatccataaagttcacctttcttatgtaaaatactctaccacatatagtataaattacatacattaatacaattattagtatatcatttattattgtaattgcaatacgttttctataacaaaaaacaaaaaaagaacgctataaaacgttctttttatttaattctttaattatgttttctatacagtatttaaaataaccgttattgcttacttcaatatcacagtattttttatataaaccaattctgttattatacaaattataaatatgctcttcgttattttttaaaagtggtctgtccttaccgagatttttggattttaatatattttcaacacttctgtttataaatactattatgctcgtttgtttaaaataatcaatgttttcttttcttgtgactattccgcctcctgaagaaataagagtggaatttaattttgaaagctcttttgaataaaaggtttctatatctctaaaactttcttcaccgtctttaaatatttcactgatttttttgtttgtcttttcttcaatgtaattatccatatcgataaaagttaaaccaagcttacttgcaagttccttacctatactgcttttaccacagcccggcataccgattaataaaatattcttttgcatttttatatttcctttttaagtttggatataatcttatttgtatcttcttttgaaattacaaagtcattccatatttcttcagattttaaaccttgcataataagcatttcaattccgccgcaagttttcttacctaagttttcacctatttccataaactttgtttttagcggattataaacaacatcaacaacataatcaaagtttttgattatatcttcattaacaggagaaaaatcaactttaggatacattccaacaggtgttgtatttattattacttgagcttttatttcttttaaatcttcatagtcgattaaattaacgtcattttttgcttgtttatcgcttttgttacgacttaccaaataaacttcttttgcacctaaatccttaacgcaagaaataacggccttgcttgcgccgccgctgcctagtattacaaccctactattatttatttctacattgttcacgttaagctgatacataaagccgtaataatcggtattatatccgtaaagttttccattaacattttttattgtattaacggcaccgattttttcagcctcttcgcttataaaatccaaaccatccataacggttcttttataaggaatagttacgtttattccgtcaagattattttttttcataaaatcttttatattttgtgccgtatcaacatctatttcataaagctcatactcatagtttaaatttaatacatcaaaagccgtattatgcaaaatttttgaaaaactatgaggtaatttttcaccaattaaaccaaattttttcatatctatcctttatatgttccaagaattcttatatatggcaaatcaccgtcaagtccgtataacatttttaaaacattgctatcttgtaaactgccgtcaaaattaatgtaaatcgtaaattcttttctgtatatatttgtttcttttgaatctattttattaatgtggatattataatttgcaaagtatcttattaaatgacttaatgatttagatttattgtcgattttaacaagtaaatctactttagtacaatctttgcagaaatatttatctttaccaagaattataaatttgtttaaatcttcaagtttatcagatttatttttgtttattacgtttaagttatcatcaacaataaacttatcttttatataaacattatcataagtctcaagaaaagaatacatttttgcgatatgcccgtctccggcattatctaaagccaaaaaggcaaagtctatttccccgtttgaaacagcttttaaaatatcttcgtattcttcaaatttaattacttcaaggtcttttttaaaatataaattcattgcatctattgacaaatgatttattttatctatgtaacctatcttattagcactttcaaccaaatcaatagtatatttttcttttattatgtttattgccttatcggcaattgcttttctttgaaaattcttacttatatccataatatgattgaaaaagtcggcaatctcttctgaataatctttgtttttaagattgtttattgcattttcaactacctgtgcttctcttttggtatttaatacttcgatattattttcttttttatacttcgccacgtctacgacagtattcattctttcttcaaaaagtttcactaactctttatctatttcgtcaattcttcttcttgattcttccaaactcttcatacataactcctaatcacataacaaaaaatcatataaacaaattgcacttgccgcttctattacaggaacagctctttttacaataacgggatcgtgccttcccactatttccaaacttgtattttcctttgtttcgacatttatggttctttgctttcttgagatgcttgcagttggttttattgcaacactaaagcatattggctgtccgtttgatattcctcccaaaactccgccgttgttatttgtgaaagtttttacattgccattttcatcataataatattcatcgtttgcttcacttccaaacatatcggcaaaagcaaaaccttcaccaaactcaacacccttaactgccggaacagaaaataggatatgagccattcttgattcaatgctgtcaaaaaacggagaaccgatacctgccttaaaacctattataccacattcgatgattcctccaatgctgtttttttcattttttgcatttaaaattacatcttccatctctttttgccttgttttatctaaaagcggaaatgattcgtttttcaatccaatcagaatatctttgtttatatttgtgtaatcgaaactcaaatcttcgactttgtttatcttttttatatgtgcacctatgtatactccttctttttctaaaagttgttttgcaattgcacctgcaaaggttaaagaaagagtaagtctgccggagaagtttcctcctcctctgtaatcattgcttccgtgatgttttacatatgcgggataatctgcatgagaaggtctcatttttactttaagctcgctgtaatctttacttcttgtattgctgttttcaaatattgcacaaagaggagaacctgctgttttattatcaaaataaccgcttattatctttggagtatcggcttcttttcttggagttgaaaatttatcgcccccttgtcttcttttaagttcaaaatctattttatcaaaatcaagggttactcctgctggaattccgtcaataacaacgccgattgcttcgctgtgagactgcccgaatatagttactttaaatttatttccaaatgtcgcactcatttatttctcctccaagtttcttaaagtcttcataaaaatgcggataagattttttaacacacatataatcttttattatgatatcatctttgcatctgcttgatgcaatggcaagactcattgaaattctatggtctttgaaagaatcaacatatcctccatttaaagaatcaacaccgtttattgtaaggctttcttcatgttctataatatcagcaccaagtttatttaactgagttgaaattgcagttagtctgtcacattcctttattctaagtcttcctgcatttataatttcagttttccctttagttaaagctgcacacaccgtaaggataggaataatatcagggcagtttgctgcgtcaatcactttgttttcatcatttttaagtacttcaagccattttaatatttctttatcaccttgaagagaattttcatcaagaccttttatgtctatatcattaccaatatagttcgcactaaggaagaatgctgcctgggaatagtctccttcaacggtataatccattgccttatattcctggtttccttttattataaattctttatagtccttattttcaatttctataccgaatttttcaagcattgaaagagtcaaatccaaataactttttgattcaagttttgaaattattacaattttgctatcatcatttaaaagaggaagagcaaaaagaagtccggttataaactgagagcttatgtctcctcttacataaaatgtatcagcttttaattttccctctacttgcaaatccaaaatatcttttttataagaatattttattccttgtttgtcaaatatttcgtaaaaaacattaagaggtcttttgcctaagtttcctttaccgataaaagtctttttttgattaagaagcattgttattggaacgaaaaatcttaaagtagagcctgactcgttacagtccactataaaatcttcattgtttggagacgataaaatcccctctaccgctacttttctattatctatttctatttttgctcccatgcttcttgctgcgtttatggttgctattatatcatcggataagtctatattatctattatagacttaccctttgaaagagcagcacatataattgccctgtgagccatgctttttgaaggaggaacaactacttcccctgataattttcttggtttaattaaaatattgtccatttactcatccttaaaaaattgtgtatttgtcttatgtatataacattttcctatttcatttaaaagaattacgtttaaaacttttccttcgtttttcttgtcggtagaaatatgagaaagaatactgtcattatttattgccccgatatcgtattccatatcaaagttaattaaaatatcttttattttatcgcttacgcctttaggtgtaagaccaagtttttcactgtgttttgttatttcatacattccaatccccacagcttcaccatgagtatatttttcatagttaaagtgagcttctattccatgagcaagagtatgaccaaaattaagcttcattctctcccctgtatctttttcatcttcttcaactacaattctctttaaattacagcttgtgtatactatatgttctatattatcaagtatatcttcttttgttttaagattatataaaaattcaaagaaatctttatcaaatataagaccgtattttattacctcagccaaaccgtcttttatgtttctaagggacaaagttgttaagacatttgtatcaataagcacaagctttggttgatgaaaacttccaactaagtttttgccttttttaaggtctattgcaacttttccaccaacagaactatctacttgagataaaagagttgtaggaatttgaataaaaccaactcctcttagaaatgtagatgcaacaaaaccgccaaggtcacctataactccgccccccaaagttataatcatgtcttttctagtcatgttaaaatcaataagagcattatatataggttcaagagattctatggattttgttttctctccgtttggaagaattatataatcaacattaaaacctccgtctttaaggttatttataactttatcaagataaaatcttgcaactatatcgtcggttataataaatagtttttctcccttatatactttttttatttcttctgataatgattttaaaataccttctttaataataatatcgtaagatttttcattaagatttacatgaattttcttagccataattttttccttatagagttcttccaacgattggagcaagttttcttaaatctgtcattaaatcgtcgaatgcttcaggttttagagattgttgtccgtcacataaagcgtttaatggatcgttatgaacttcgataataagtccgtctgcacctgcaacgattgctgctttagctaaagattcaaccatccaccatttacctgttgcgtgtgatggatcaatgataattggtaagtggcttaattttttgattgctggaattgcgcttaaatcaagagtatttcttgtgtatgtttcaaatgttctaatacctctttcacaaaggataacattttcgtttccgcctgccataatgtattcagctgacattagaagttcttcgattgttgcacttaaacctctttttaaaagaataggttttctgattttaccaagttcttttaataaatcgaagttttgcatatttcttgcaccgatttggattacatcaacatcttcaacgaatttttcaaggtcgtttgtagacattaattcagtaacgattggaagtcctgtttcttttcttgcttcttttaaaagttcaagtccatcgtatcctagaccttggaaagcgtatggggaagttcttggtttgaaagcaccgcctcttaagaaatttgcacctgaagcttttacatcttttgcaacttgtgtaatttgttctcttgtttcaactgaacaaggtcctgcgataattgcaagtttttcaccacctataacttggtttccaactttaatttcgctgtcgtttgggtggaacattctgtttgcttttttgtaaggttcttcaacatgtaaaactcttcttacgattgagtttgcttcaagtgtttttgcatctaaaacagatgtatcacctactaaaccaagtacagtaagttcttctccttcgattggttggatttttaaatttttgctttcgatttgagcaaccaatttggctacttcaagtttgtctgagttgggttgtaatactactatcattttgattttctcctttaagttaattttttagttttgtaaaataaaaaagggaactccttttaatgagttccccaaattctttactttgcgttttttaaatacatttaaagattatactcactaaaaggcttatctgtacgtgaaaaagaacctgcaaagaaataaaagtttgcaaagctaaaatagttataaaatttaaagctatttagttctcttaaacctttcattttaatcttctcctttgtattcttgtttgatataatacacttattgtttttaattgtcaagaatatttagtaaatttatgaaattttttcatacagtttactttttatataacaaaaaatgatttattttcattacgttttattaatttttttaattatgaaaaatcaacaatatatttaatatataccatattcttccatcatatttatgattccctcatatatttttcccataataatgttttgatcttcatcgctaagaggctctactttccattttccatctacttttacaagattaagctcaatttcttcagtataaacatcaggtttaaaagtttctaatgattcaaaaaaacaatcctcaatatattgctttgtttcttcatccgtcattgaagaattatttgcttgttcttttgcgccttttaccactgcatatgcaactacttcgccaatattttcatttgttatctcagcctttaccactgctgtatcacctttttcttctacatctataattttatattgcatattttttgtagtacgtgcataaacgtcagtgctgtttaataccccttgttctatcatcttattaaattcttcttctatagaatagtctatatttaatacatcgtctaacattgtaaggtcaaaatttttatacccctcaagcaaggtaactgcaacacctttaggtgaatttgtttgttcatttgaatttgaacacccaaaacctatcaaagaaaacataaaaactaaaattaataaaatactacttttaaattttttcatattaatttccccttatttttttattttattataatactttactttaatataattaaaacataattactatatattgtaaatcacatagtaattatttgtgaaaattatattataataattaacttttaattaagtatttattaaatatgaattttaaacatttattactgatataattaacataatttaaggagggaattattatgaaagttaatttacaatcttttaaccggaatttaaaagaaagttttaaaagatttttatcatcatttgtatttttgattttttatttaacaaatactataataatgtattctttagatgttactgaaaaaatgttttactgcataaataaaggtatttttgcaggcatttttatatctatatttatatattcataatttaaattttcttttaactcatatatatcagcataaatatttaataaattaaagtattctttttcatccaaattaaaaaggcttaaatttaagagttttcctattgaaactattattttatcggcttgtttttctcctgttttaaaaatttcatggctattttccataatagataaacattttgatattttttctttatgttttttttgaccgtcatataaatctattagtgttcccatacttttttcctttttggtagtatattataagatactaatattatacacgatttatagtaggatataaagaagcaatttaaaaattgcttctttatagatttatttaagtgtaattgtttttggataagtataagtataatctccatgggtgaatttaactttatattttcctttagggagaagttttttattatacttatcataatttccgtatcctttaaaagttacggagttttttgtatttgcctttttgtagtaaaatacttgtttaaaaaccagcctgtttttactgtcatagattcttaccatgcttgttccaggtctgtttggggtcatatataatgttgttgaatactttctttttattgatgttttggttattcccgtagaaagctttgtagcttttgagtaaaccttaattgtataatcttttgtttttgtgctttttcctgaaacagataatatgactctaatagtataattatttccttttgaacttctatttacatagcttcccgttttatatcctgctttgttatcctttgttgcttttccgtcccagtaaattttttctgttgttgttcctgtttttgattttgttaaacttttctttgcaacaagctgtttttttgaattataaacctgaagttctacttttgcattttttatatttgaatatgcacttatgtcaactcttaagttatttgcatatcccggagtaaaaccgtagcttaaggcagggtatatcttaattgaggatattgatattttaggtgttgtggcattatcttgagttatgcttgtttttccttttcttacaatatcaacatcgctttttttgatgtatccaactgaagaagtatgattatataaattttcatagtgaacagaagagtttacaactcctatgtcagtttgtattttataataatcacctttttctccgattataacaacaggcattccagtaggtgtactggagtttttgtttgccattttatagtaagttttgctgctactatctgcattttgatatacgtttgtggttttgttggttatggctattgtgtatttttcatagtctttgcttcccatgtttttatcttgaagatatacgttaccgcctattttttcaccatgatatgggtctgaggcatactttacgtttactccaatctttttattgccgggagaagttccataatatctaaagtcagagtttgcgtcaaaatatgctctgcttaagtgtctatacgcatgttcttctatacactttgcggggcttgaaaagctataagcattatcgggattttcatcatatgcggcaattccaaaaaggttattttttgtttgtgcataagagcttgttccgtatccgctttcaaggtttgcaaagcctagttccataagagcatttataccgtatttattttgaacgtttattaaggtttcacccatatttttaagttttgaatttgtagggtaggtgtttattcttttatttatttctgctgctgtgtagcttgttttagttctatatgaaagatatgtaaagtaaggataatgtgttcctgctttacttgatgaagtaaggtattttgaagtataaaagtttactccgtccatgctataatacttagtgccgcttttcataaaagaaggtgctttatctacaacaaaactttgcagcatagatttttcgctgttttcatatctttgtgaatttactgcgtcacttaataccgatacatagtgatataaatctgagtttgaatttacgctgtaataacccatattgtatttttttgtattagatgaacctgatacatacaaatcgtcaaataagacttccggaacaaatgtaagattatctgaagatgtataatttgttattccgcttattcctattttgcattttgaagatgtgtaatttccattattttccgcacctaaataaaatacttcttggttgtttgtgatatatggattgcttgagccgtaagcattatcaagaacgagcatagccgatggggcagaaatataagctcttcctgttttcatgtctattacttcttcatcttcatttaaaataacaagtcctttagctttttttatgtattcgcttgtatttatatttatatattcgttataagtattatccatataattttttgcatttgtaaaagtatcaaaggtttttaatttttcaaattttacaatactgttgtattcatcgctttgtttgttttttgcagagtatgcatatgcaacataaaaactatttgatatttcttttgttctttttgcattagagtttaaatattcttttggtattttgtctgttttgtaatattgttcattttgtgcttcgttttttacgaaatcgggtatttcaatattatataaatcctgtgcttctacgtttaaacttggaatcattaacaagataataagtaatatagctattatttttttcattatgtataactccttttatatttgtaaattgaattatacataaaaaagttttgattacaacataaagataaaattggcaaaattggaaaaaaataaaaaaatcctcaaatgaggattttttaagcatctttccaaacttctgttgctatttcttttacaagttgtaattttttaaattggtcttcttctgttatgttatttccgtcttctgttgaagagaaaccacactgtggacttaaacataatctttcaagaggaatgtatttgcttgcttcttttattctttcttttattacttctttatcttccaaagttccttctttacttgtaataagaccaagtacaagtttaccttcttttaatttctttattggttcaaaagagcctgctctgtctgtatcgtattcaaggaaaaatccgtcaaatggagctttaaatatataatcttcaacgaaagaataatctccttcatataaccagctgcttttgaagtttcctctacaacaatgtgtagttattgtcatatcgtcaggtctatttttaagagagtttaccgtgatttctgcgaagtcttttactaaattttttgtatctattcctttttcttccaaagcttttctctgtccttcgctaaataatgcaccccaagcagtatcatcaaattgaagatatctgcatcctgcgtcataatatgcttgtattgcatcttgatatacttttgctatatcttcttttaatttttcaatagatgtataatttgtgtcttttttaaataaatcagaatttacaactccggaataataaatcatgttaggtcccggaattgttgtttttgcaacagcatcatccccgcataattcttttaaatatttaaagtcataaaggaatgggtggtcttttgggaaagaaattgtatctttaacatagtaagattttaatttgttcattgttccttgaaatttaccttgcatatctaaaacgtaagtctttatgccatttaagtgagcgataaaatcataatgccagtattctctgttaaattctccgtctgtaattgcttttaagccgatttctttttgtttttcaacgattttttttatttcttctctttcgatttttttataatcttcaaaagaaatactttcattttctaaatttttctttgcttctttaagtgtatttgttctaagtaggcttcctacttggtcatatctgaatggtccttttgtcatttttaatacctccgagttaatatgttatttattatactcctattttttttgtttgtataatatataaaaatattggtttgatatagttttaaattatacctgtaatgtaatatattttttgttttatataagaacatataaaattttataaagtttcgttttttatttgattatgttttgtcatatggttttaggtttatatgcaatcattatgattgcaatgaaaaatacatttacttttaataaaataaaaagtataattaaataatcaaataataaaagaggataaaaatgataacatctaaaacaaataaattaattaaacttataaaaagtttagaaaagaaaaaatatagagataagaacaatatgtatattcttgaaggaaggaagtttgttcttgatgcaataaacgggggagggaatattaaatatatcattgcaacccctgattatgtgaaagactataaagatgcaatagaagtaagcgaagagatatttgattatatttcaaccacaaaaacacctcaaggggttcttgcagttttagaaatagagtataaaacattagatgatataaaggaaagtgctaatatattataccttgataatctgcaagacagcgaaaatgtcggagggcttataagaagcagtgtttgtgctgattttgacggtgttgtaataacaaaaacaaccgcttctcctttttctgcaaaggcagtaagagccagtgcgggaagtattttaaatacaaaaataattaaagatgaagattatgttgttttaaatgaattaaaagaaaaaggttttgagattattgcttctactttaaagggaagtgagaagaatgattttaatagtaaaaagaatgtgcttattgtaggcaacgaaggaaacggaataagtgatgagtgcctaaaatatgcaactaaagaagtaaagattccaatgagcggaaagtgcgaatctttaaatgcaaatgtaagcggtgcaatacttatgtataaaatttatggatattaaaaaaagaccgaataatcggtcttttttattgtgcttttttatcaaaagcttctttaaccatttctttagtaatggtaatatctttcacatcttcattgtttggagcttcgtacataacatcaagcataatatcttcaagtatgcttctaagtcctcttgctcctgtttctcttttaactgtttcgctggcaattaaatctattgcatctttatcaaaatgaagatttacatcatcaagacttaataagtatttatattgtttgattaaagcatttttaggttttgttaggatatttataagtgcttcttcatcaagttttttaagagatgcacttataggaagtcttcccacaagttcaggaatcaaaccgtattttacaaagtcttgaggttgtgccatgcttaaaagttcatcagatgatttatctttacttccttgtatatcatttccaaagcccattgagtgggtaccgagtctttttttgattacttcgtcaagtccgtcaaaagctccgccgcagataaacaagatatcttttgtatcaatttgaatgaaatcttgatgaggatgttttcttcctccttgaggaggtacgtttgcaacagttccttcaagtattttaagaagtgcttgttgaacaccttcaccgcttacatctcttgttattgatgtgttttcgctttttcttgcgattttgtcgatttcatctatatatattatacctttttgagcaagttcaatattataatctgctgcttggataagtctaagtaagatattttcaacgtcttctccaacgtatcctgcttctgtaagtgccgttgcatcagctattgcaaaaggaactttaagtatttttgcaagggtagatgcaagaagagttttaccgcttccggtaggtcctgtaagcaagatattgcttttttgaagttcaacctcgttatcttctttttgtttatcggtaacgtttattctcttatagtgattataaactgcaaccgctaaagttttctttgcttcgtcttgtccgataacataatcatcaagtaattcttttattctttttggtttttcaacttcatttagatttggagttagagtatctgtaaattcttcatcgtcatataatgtttcgttgaacatttcgctgcataaagcgatacattcattacagatgaaaactccaggtccggctactaaacttttaacttcagattgacttttaccgcaaaacgaacaatggttttggttttcgtaattgttattttcgtcactcattataatagccctcctttattatcttttttcaaagaccttatctattaagccgtattccatagcttcttttgcactcataaagttatctctgtcggtatctttttcgattgtttttaatgtttttcctgtttgtttgctaagtattttgtttatgtcttctttaattttcaaaagtcttcttgcatggatttcaacatcgctgctttgaccttggaaaccgccaagaggctgatgaatcataacttcactgtttggaagggcaattctttttccctttgttccgcaagcaagcaagaatgctcccattgatgcagccataccgatacaaattgtagatacatcgcatttgatgtaattcattgtatcatatatagccataccggcagttacacttcctcccggagagttgatgtaaagttgaatgtcttttgagctgtcttgagcttccaaaaataacatttctgcaacaacaaggtttgcaacctcgtcgtttatttctccggttaaaaatataattctgtctttaagtaatcttgagtagatatcataagagcgttctgctctaccttcattttccactaccattggaattaatggcataaaagtacctccgtattgtagaattattttgcttcttcttcttttaccttggcattttcaattaggaaatcaaataattttctttgtttgatgaagttgttgatataatcttttgttgtatcatccattgtttttttgaagtcttcaactttttgattataagcttttgcaaagtttgcgatttcttcttcaacttcttcatctgttgcttcaaagttttcaacttccataagttttgtaagtaccaattcttgttttacgtcatgttcagcttgttcttcgaataatttcatgaaatcatcttcgtttttgccgccgttttgacttttcattacatcatagtatgttttagggtcaattccgctttgcatgatttgttgttcaaattgagcttttacgtcttctgcttttctttcgatcatgcattttggaatatcaatttcagtgttgttgcaaacttcttcaacgattgtgttgatagctgctcctcttaaattgttttctctttgttgtttgattgttgcttttaagtcttctttgtattcatcaagagtatcgaattcgcttacgtcagctgcgaaatcatcatcaagttcaggaagttcttttgcttttacttcatggatttttactttgaatacactgtcttttcctgctaaatcaggagcatggtattcttcagggaatgttacgttaacatcaacttcttcacctgcttttttaccgataagttgatcttcaaatccaggaatgaaagagttgcttccaagaactaatggatagttttcgccttttccgccttcaaaagcttcatctcctacgaaaccttcaaagtcgataacaactgtatctccttctttactttctgtgtcttcaacgcttactaatcttgcgttttgttctcttactctgttaagttcgtcttcaacgtctttttctgttacttcgtattcgatagggtatatttcgatacctttgtattcgccaagttcaaattcaggttctaattcaacttcaatagtaaatgtagcaccttcttctttgcttatgctgtctaattttgtcattgaaggcatatttactggttttaaatcatgttctttgatagcttgttcgtattcagctgggaaagcttcgtctaaagcatcttcaaagaatattccttcaccgaattttctttcaataatttgtcttggggcttttccttttctaaaaccgtcaatgctgaatttacctttgttttttttgtatgcagcatcgatagctttgttaaaatcttctgcggaaacagtaattgtaattgttgccacattgttttcttttttatctaatattgaactcatttataattttacctcctaagtcccatctaatcaaaatagtattatatcataaatgacgagaaattcaaggtttacgagagttttgtttgtaatatatgtttattttttttgttttttttataaattcatattaccttttgattttagctatttctttttcaatttcttgtaaaaatttttcttttacttttgaaaaaatttcctgttttctccatgcaaaaaccactcctacttccattttgggttttaggggaataaaaaccaaattgttttcttttgtaccttgaattatcttatctaagcaaagagcatatcctatgtcttccataaccattaaagatgcattatataaaagattatatgttgcttttatgtttaaagattcaaaatcaccggaaataaaaccgctgaattcattttttactatttgctgagatgatattataagaggaagtttttttaaatcttcctttgttatatattctttttttgcgatttcactatctttttttgctaaaattccccatgtatcatgataaggaagttttatgtagttatatttttttatgtttacaggctcaatgaaaagggcaaagtccaaaagacctttatccagtttttctcttatgtcgttggaatttccgctggttatgtgaaactttacgtcatgttgtttagagaagtttttcattgcttttgctatcattcttacagagtatgattcaccacagcctatatatatctctccctttaaattttgtcctaaatataacatttcttcttttgttttgtttgtaagctctattatttcttttgctcgtttttgtaaaattcttccttcttctgttaatgttattttccttcctctgataaaaagagtttttccaagctcctcttcaagttctttgatttgtcttgaaagaggaggctgggtcatatttaagacttttgcagcagatgatatactttcttcttttgcaacggttaaaaaataatttagtacttttatatccatttaaacgctcctttattagtatacttttaaagtatattatcttatataatatatatatttgatattataacatttaggatttataattaaaagagaagtagtttattaaaaaggagataacatggaattaaaagattacttaaatcatttaaacgaaggtaaggtagttaaaggcggaagcgacgtacatttatatatgcataaagtaagcgatgaggcaagaagaattacatcacaaataaatggaaagtatcatacaaacgatgaaataagagaattattctcaaaacttattggaaaagaagttgatgaaacatttgctttgtttccacctttttattctgactgtggtaaaaatataaccgttggtaaaaatgtatttttcaactccggctgctgtctgcaagatcaaggaggtattgaaataggggacggttcacttcttgggcataacgttgtaatagcaacccttaatcacgattttaatccaaataaaagaagcgatatgcatccaaaacctgtaaaaattggtaaaaacgtatgggttggcgcaaattctacaatagtaccgggagtaaccataggagacggagcaatagttgccgcaggggctgttgtaacaaaagatgttgaagcaaattcaatcgtaggaggagttcccgcaaaatttattaaatatattattgaagaataaagcacggttgttaccgtgtttttatttttttttgacaatttaagtatttaagaatatacttaaataaaaaaattaggagaagttaatgaaaagtaaattttatgcggttgtttcaaataattgcgtggcctgcggtgcttgtatgaaagtatgtccaagagaggccataaaagtaaaaaaaggagtaagagcttttgttgatgagtctttatgcgttggatgcgggctttgtgtcaatacctgccctgcgggagtaatcagcaaagtagaaaggggaaaagatgaataagaaaaaacattggtatgattatttgtggatatatacaccactatatttgattttaggtttatttaacatattatttgcatggcttggaatgattgaatttttaattcctctttttattgcattatttggaggaggaaaagctttttgcaataaatattgtgcaagggggcagttatttgatatacttggtaataagttaaatttatcaagaaaaaaagttcctccaaaatttttatcgtctaattggtttagatattcatttttattattttttatgagtatgtttgttttaatgataataaacaccataaacgtattttggggagttaatgatttaaaggaagtaataaaaattttatggacttttaaggttccttttggattttcttatacttcgtctattttcccagactttgtagcacagtttgcatttggaatgtatggcatgatgcttacatcttctattttaggttttgttacgatgttattttttagacctagaagctggtgtgtgtactgtcctatgggaacaatgacacagtgtgtgtaaaataaaggaaggtggttttagtggaattaaaagcgcagaaagtaagtgatgttttaaaaataatatcaaataaaaatcgtcttcttattctatgctatttggaagagggagaattaagtgtaggtcaattaagcgaaaaaattgattccatttccatggctgcaatttcacagcatttaaacgcacttaaacttgcgggtattgtagaaagcgagaaaaagggattaagtgttttttatcatataagtgatatgagagttgttgaagttatgaaaactttaaaagaactttactataaataaaaaaagaaagtatttatactttcttttttttaaacttcgttgatgatttgtacatctttcatttgttcttttatgtattcgatgtttacatcttttatccatatatttccattgtcaacaccaagtttatttccgtcaatatagcaaataagctttgttgaatctttgaaatatacatataagatttcgctggtggattcgttgttcccaagaattttaattttataactgtccaaagatcttattatttttgttacttcgttgtcatttccgcttatggattttttttcttccacaaccgacatgaaaggctcgcctttgtatttaatgtattctatttttgttatttctttaccggctatttggttatccattacggaagatagcatgctgttttttgcaatcttcggagtcagaaacaaaattaaaattagtattattcctatagcaataaatggaatatatttttttttgaaatttaagttaattttagaattcatttttctttaattattttaaatcctttcctttataaccaattacttccattacagggattacgaacataaagccaagccctttggtttctatattgccaaggagtttcataatttctatttttacttcatcaagcttttcttcgcttttgataattgaaattattgtaacgttcttaggtttgtttccgtttaaaatttttctgatagaagtaaatgtataatcttcattattataatgcatgtttacttttccaagtcccgttgaattaaacaatgttcctcccacttcacatctggacaatatttcatgcacatcatccaccaaatacatatcgtttaaaatgataaacagagcatacatttttctacctccacacgtatcatatataatttagtgtaacacaattttttaaaaaaatctaataaaaaacagaggtttggtattttttcttgtattttaaatttagttagggtataattaataaatgattagacaatttctaaagattatttaaagagaggttgatataatggcaaaaagcaagcttcaagtatctaataaaagggttaattacgaacaaattgatactattgtgggaagtgatataacttttatcggagatcttgcagccggtggaaacgtaagatatgaaggtaacttaaaaggtaatgttaatttagccggtaatattattgtcggaagaaatgcgtttattgcaggtaacattaatgctaaaaatgttcatataataggtacggtggaaggaattgttacatgtgaacaattaaaaatattatctaccggtaaactaaccggagacgtttatgttgataacatcatcattgatgaaggtgctatttttataggtgcatgcaaaacaaaagttgcagatatggaagatgaaactcaaataagcgaagcaatggcaagcgataaagatgtagacttagacacaaaagaatctgaagaagcttaatttgtgataaccttaatctaaagtttaaataaattctttattgaaaaatttaaacaatttaattatttggaggtaagaaaatgaaaataacaaaagaaatgggaattatggatatagtaaacaaatatcctcaagctgtttcagtatttcaagcatacggaatgggatgtgtaggatgtatggcagcaagatttgaaacattagaagaaggagctatggctcacggaatcaacgttgacgaacttgttgatgatttaaacgaaaatatttagttttaaagcctcttttatcagaggctttttttgaggagatttatggcgaaacatttgtatgaaaatatatatgaaaaagcagattatgtaagagagaaatattttgttgatacttatcccgtaagttttgataaatttgatgaaatatttgaagatttacactataaagtgaaattttttgataattgcgataagtcatgcgttatcggaaatatgcttattgtaggtaatacttcaatggatgaagaagaatttttaaggaaaaattctacactaagtgatgagacaaaaaagaggagagaggctttggctcatgaagcagggcatttgttctgtcacagcataaatcagcttgaaagtttagacttatcccttaataaagaagaagctcaggctgatgctttttctttgtattttctaattcccgatgatttgtttgagagtttttataaagagtcttataattcttatggctcttttaattattatgaagccagtgatacttttggggttactgttgaatttataaaaaagagaaaaaaatattttgaaaaaagtatgagacacgaaaaagaaaggttctttgatgatttttaaaacttccttaatatttgaggaagtttttttgtgactaaaatgtgaccaaatgttctaatattattgcaatttacctaaaaatatattatctttaacatatacatataaagaggagagaaaaatgaacatatcaaaatggctatggcttatttcaactcaaaatatcggtgcaaaaagagcaattgatttatatgattatttcggttcaattgatgcggtatatgaaaatgataatataagcgaatatatgaaaataaagggcataaatatggatactgctacaagaatggttaccgacaaggatttgaagaaatacgatagaataatagataaaatgtataatgaaagcataaactatattaccatggacgataagtattatccttgtgctttaatggatacatacgattatcctcctgtgcttttttataaaggaaagaatctatttatggaagataatccaatgatttcaatggttggaacaagaagagcaagcaattacggtatgaatgtcgcaaagcagtttgcaagagaattttcaaataacggtcttgatgttgtaagcggtatggcaataggaatagatacatatgcccataaaggagccttagagggaatgggggataccatagctgttttaggatgcggggtagataaagtttatcctaaatcaaacaggaagatatatgatgaaataatagaaggaagaggtatggttgttagcgaatatttgccaggaacggaacctttaagtcatcatttccctgcaagaaacagaataataagtgggctttcgcaaggaactgttgttatagaagcatcctttaaaagcgggtctttgataactgcaaaatatgctaacgaacagggaagagaagtttatgcagttccgggaaatataacttccagagtatgcgaaggcagtaatgcattattaaaagacggtgccaaaattattttaagcgcaaatgatgttttggaagatttatattatattttaaaaagacctgttatgcataaggtgacggaaattataaaagaagaagatttttatgatgatattttgaataaatataatttaacaaaagaagaaaagcttatatgtgaacttataagagatggtgacaatacggctgatttaataagcagaaagctttcaaaagaaataaactttataaattcaaccttgacaatgttagaaataagaggtattgttattagcacaggcgcaaagcttgaattaagataggctttgaagtctattattacttgaaaggagcagtagatgtcttatagattagtaatagtcgaatcacctgctaaagcgaagacaatacaaaaatatcttccaaaggattgtaaggttgtagcctcaaaaggacacgttatagaccttccaaaatcaaaacttggaattgatattgaaaataattttgaacctgaatacaagactataagaggtcagggggaaagacttaaaaaacttaaatctgatgcaaaaaaagccgatgaagtcattctcgcaactgataacgatagagaaggagaagctatttcttggcatatcgccaactatcttggtcttgatttgaatgataaaaacagaatggagtttttggaaattactccatcagcaataaacaacgccattaatcataaaagaaaaatagatatgaacatcgttgatgcacaacaagcaagaagagttcttgataggcttgttggttataaaataagccctgtactttggagtaaagtacttcgtggacttagtgcgggaagagttcaatctgttgctcttagaatgattgttgatagagaaaatgaaataagaaactttgtaagtgaagaatactggataatggacggtatttttaaaaaaaaagatacaaaagaagaatttttcagtaagcttgctttaataaacggtaaaaaagcccaaataaataataaagaagaaagcgataaaataatagaagaattaaagaaaaatgcttttattgtaaaagatgttaaaaaaggagagaagaagaaaaattcaccgcctccttttgaaacaagttctcttcaacaagatgcaagcaataaacttggtttttcaatttccaaaacaatgatgcttgctcaacaattatatgaaggggttgaagttgagggaataggacaaataggtcttatcacttatcttagaactgactctacaagactttcaaaagaagcagttgaagcgggaagtaagtttataaaagataaatatggagatgaatatcttggatatacaggtcctaaaggcaaaagcaacagtaaaattcaagatgcccatgaagcaattagacctactgatgtaaacttaactcctgaaaaattaaaaacatctcttactgctgatcagttaaaactttatactttagtttataacagatttttggcatctttgatgagccctgctgtttatgatactttaagggttgatatagaaaacggaagttacacattccgttcaacaggttcaagggtaaaattcaaaggttatcttgaagtttacagttatgcttcaaagaaagaagatgaaaatgaaagtataccacttgttgaaaagggcgaagaggttttattaaaagaattaaaacctgctcaaaaattcacacagcctcctgcaagatataacgaggcaagtcttgttaaggttttaaaagaagagggaataggaagaccttctacatattctcaaataatcaatacaataaaaaacagaggatatgttgaacttgaccaaagaagatttgttccaacaatgataggggaagccgttgataaacttttaagggagaatttcgaggatatagtagatatagattttacggcgaacatggaaagtaaccttgatgatattgaagaaggaagcaaaaaatggaaagacgtaatatctgatttttacaaaggacttgaaaaagaacttgaacatgttaaggaaattgaaagaataaaacttccggaagaacaaaccgatgaagtatgcgaaaactgtggtaaacctatggttataaaatacggtagatttggaaagtttatggcttgtagcggttatccggaatgtaagaccacaaaggctatcgttaaagaaattgatgcttcttgcccaaaatgcggcggtcaaattgttgaaagaaaaagcaaaaagggaagtgtattttacggatgtaagaactatcctaactgtgattttgcttcttcacaaaaaccaacgagaaaactttgccctaaatgcggagaaattttatacgaaagcaaaggtaaaaagaaaagtttattttgcaaaaacaaagaatgtaaatataaagaagaattataaaaagagaggaaactctctttttttattatttatataaatattttcgatttattatttataatataaatacacgttttagatatcctatgggtattttatttaatgtttatagaaatttaaaattaaaaataatattatttttcactctattgtgttttataaataataatattaagaataaaactttaaaaatataaattaatataaataaccgataaaataatttttaactatatttatttaaaatgttaatttacgatttgctttgttaaaaaccaggattagtgcatataaaagtgcctataaaaaaatattaatttttcacatattaactatttattattataaaaagttttaatttttatagtataatattaattaataaaaaacgaaaagaatcagaggagaaaagtatgaataatttttattttcatttacctacaaaggtttattttggtaaaggacagataaaaaatttacctgaaattttatccggcttaggtaaaaaagcattgttagtttacgggggaggaagtattaaaagaagcggactttatgatgaagttttatctttatgcaaacaaagcggtgttgaattgttcgagctttcgggggttgatccaaacccaagagttgagtctgtaagagaaggggtaaaaatttgtaaagaaaataatattgatgttgttttggcagctggtggcggaagtacaatagactgtgcaaaaatgattgctgctgcagcaaaaagcgaagaagatgcttgggaacttgtaatacatcaagataaaataaaagatgctcttcctatcgttgatattctaactctttctgcaacaggttccgaaatggacccatttgcagttataagcaatatgaaagagaatatgaaaataggggttaccagtgagctttttaaacctaaagcatcaattatggatccaagttatacatgttctgttcctaaaaatcaaacggctgccggaactgccgatataatgtctcatatttttgaaaattatttttcaaacgtaaaagaaggctttatgcaatcaagaatggcagaagcattattaaagacttgtataaaatacggtcctattgcttataatgatcctgaaaattatgaagcaagagcaaatcttatgtgggcttcttcatgggctataaacggattacttagctcaggaaacgaggttgaatggtgtgttcatcctatggaacatgaacttagcgcattctatgacataacccatggtgtaggacttgcaattcttactccaagatggatggaatatgttttaaatgaaaatactcttgataaatttgttgaatacggaataaacgtttggggaattgctcctcataaagaaaaagaagaaattgctaaagaagcaataaaaaatacatatgatttctttaaaggacttgatattccaatgactttaaaagaagttgggattgatgaaactcacttggaagaaatggcagaaaaagtaggggaaataaaaggagcttataaacctttaaataaggaagatatgttaaatatttataagatgtgtctataaaaaaaagaggagaaatcctcttttttattttatataatattatgttaaaaatgaatgtaaattgttatatccttatataatattttttacttaagttttttatttaataaaaaaaggagccttagctcctttttaatgttttactattttttccataatccgtgaagattacaatgttcgtaagctgctacgaattcatcaccgtcagcaaggataaattcagcttttggtgcatcacctggttttaagtttttaacttggtgaccaagttttgtttcaatccaaatgaattcgatgaagtgttcttcaagcattggatgttcaacttcacctacttgtacgcttactttgttgccgtcaactgttacagctggtacgtgtttttctaaagcaccgtctgtttgacctggttttaattcttccattttttctccgcagcacattacaggtactcctttgtttactgcaaatactacgatgtttccacaatgtttacatttaaaaaatttagcttccatttttattcccatccttttcttaattttttatttttaataaatgtagctatttattaatttcatttactatgttttcagctaatacgtcaagttgttgtacattttcatcacttaatgcagattttattgtaatatctccatcaatgtagttgatgtttttaagtttttcaacgattgctttcattttctttgttgccattggaccccatgttccgttttcaatgaatgcaacgtttctgttttgaagattatgagctactatttcatgaagaagtgtttccattttagggaagatttcgttgttgtaagttactgatgcaaatacaattgttttatatttgaaagcatcagataagatatatgaaggatcagtttttgatgcatcgtatacttttacatttttaacgcctttatcagcgattttgtctgcaagagcatttgcagccttagctgtatttccgtaaactgatgcataaacaaccattacagaattttcttctgcttcatatgtgctccagtgattgtatttgtctaaaatcattccgatatcgtctttatctctccaaagatgtccatgaagagggcaaattagttcaatatcaagtgttgcagcttttttaagtagagcttgaacttgtggaccgtatttaccaacgatgtttgtgaaatatcttctgttttcatcaatccagccgttttcataatttacttcgtctgtgtataagtttccgtcaattgctccgaatgtaccgaaagcatctgctgagaataaaattttatctgttacgtcatatgttaccatagcttctggccagtgaaccattggtgccataacgaaagcaagagtatgtttacctgtgtttaaagtatcattttcttttacgattaaagctcttgaatcaatatcaaaatcaaagaattgtttaatcatgttaactgttttttggttgcatacaacttttgcttcagggtagcggtatactacttcgctaagcatagcacagtggtcaggttccatatgatttacaacgatataatcaagattttttccgtctaaaactgctgttaaattttcaatgaaatcttctcctgctgttttgtcaacagtatcgaataatacatttttttcatcaagtaaaacgtatgagttgtaagaaactccgttttcaacaggataaatgttttcgaataattcaattcttctgtcgtttactccaataaaatataaatcttcttttacttttctgacatttttcataatttacaaatttcctttcccttaactgtttaaacatagttgttctagtttttccaaattcaaaatttctatatgctttttgcttacttttattaaattttctttttgcattttcattaagcttctggataaagacggcctttttactccgaagaaatcagccatatcctctcttgtcatgtatattcttactttgttgtttctatctttgttttcaagtaaatacaaagatattttttcttccaaagtcgttgctgagagaatatgtatttttttcataagagcaagagatttatctgcctgaagatgcatgatgtttcttattaacattttatgaaacttacaggctctttcgcatacattaaagaagaaattccaaggaattatgagtactgttgatttttttgttgatattgcatcataataattgtaatcattagattcaccttgaaacaaatctccaaatatttctccgtcatttatttcataaaatatgtttctgtttcccgacggataatcttttactatcattacttcgccttttaagagaacatataagtaattaggtttgtcttcttctttaaatatgagttcatcttctgcatactctttaatttttgattttgaacatatcatcatttcttctattgattttatgtcaatatcataaaacaattcggattttgctattaaaccataatccatctttttctcccaaataccataaagcatgtttaatgaattttctatatagtaacaaattatagaaataaattccgtaacatttgttacgcttttatagattttacattaaaaatttattaaaatcaatcaaaattttacaaaactaaaaaaatttaataaaattataatataaagaggtgtttatgttgaatattagaatagaagaaggatatttgtataaagaggaaataaaggaactttttagggaagatacaaatatgcttgtggaaaatgatgaagaattaaaaaattatcttgaaattcaaaactacgatgaagagttacatgatttagagttaaaatattctaaaccatggggaaggctttatattttttttgtgatgataaacctggcgggtgtattgcgctaaaaaaattagataagttaaactgtgagatgaaaaggctttaagtaagaaaagaatacagaggtaagaaaataagcgaaaaacttataaataaaattatcgatgacgcagtaaatatagggtataagcatatgtttttggatactctgccttttttaaagagtgctattcatttatataataaatttggtttttatgagattgaaagttacaataattctcctatggatacttcaatatatatgaagttggatttagataaaaatcagtttgccgaataaaattttttaattgtaatttataaattttatttataatggtaagttatcagtaaatagcaattcattgtttagtgattttgatattaatttaattataaaaaaataaaataatactctcatcgtaaacatcaatacacattaaaacaaatcaatattgcatattcataaaaatattgttattattatagaaaacattttgaacaaataaaaattgaggtatagatatgtctgaagataaaaaaactattttaagcggtatacaatcaagcggagaatttacaataggaaattatttcggagcaataaaaaactgggttgaacgtcaggatgattataattgtatgtattttatagcagatatgcatgcaataacagtaaatcaagttcctgcgactttaagaaagagatcttttgaatgtgcggcaatgcttcttgcaagcggtattgaccctgaaaaatctcttttattcattcagtctcatgttcatcaacatgcagaacttggctggatacttaactgttttactcatatgggcgaactttcaagaatgacacaatataaagataaatcaaaaaatcaaggtgaaaacataaaagtaggactttttgattatcctgttttaatggctgctgatatacttttatatcaagcggatcttgttcctgtgggagatgatcaaaaacaacatcttgaacttacaagaacaatagcaaacagatttaacaatacattttcacctactttcaaagttcccgaaggttattatggtgaaagcggggcaagaataatgtctcttcaagatccaagtaagaaaatgtctaaatcagacgaaaacaaaaacggatttatttcaatgatagataaaaaagatgtaattatggcaaaatgtaaaagagccgttacagattctgatatgaatattatttacgacaaagaaaacaaacctggagtttcaaatcttcttgaaatatattcttgtgctacaaacaaaacaatagaagaagccgtaaaagattttgaaggaaagaattacgcatactttaaaacagctgtaggggaaagtatcgcagacagacttactcctattcaagatgaatttgaaagactttgtaaagataaagcatatgttaacgaagttttacaaaaaagcagtgaacaagcaagctgcattgcaaacaaaacacttagaaaagttaaaaagaaagttggattttacagtttataaaaagaggagagatctcctctttttttattgtatataaattatgtatgaggttaatttagtctttttatgataaataaatgatataaaggataaggtaaatatagattacagtttataattactttgactatatttataagatatgtttacaatgtatgtttgtgaatttaaaagaagatatttatttgatatcatgattttttataaataaaaaggtaaataaaaaatatgttttatcattaaaaacaataaagtacatatagaaatgtatttatagaataaactttttattaataaattttatttttatattttaataaaaaaaataaaaaaacagttgacaaagagaaaaaataatgatatcttatatacaagttagcaatgactaacaacaaataaaggtgaaagaattatacccatatttttttaaccgcatgttagcaaagactaacaatatttatctcttttatatatgaatcggatatgtttcgatttataaaaatttcttttcattacattatagaattcaaggtaccgtgacatatatgttttagccttccaattattcccttcacggtaccatgactttctataaatggaggttattatgattgaaaaatatttaattgaacattgttctccaacccttgcaaatcttaaaacggcaaatttgttttcatttaaagttagtgacataaaaactttaaaagaaagtataagggcatggaattatgagcttaacgaaaaaggcatatatttatctttactaaatgtgaaaaataacttagcccttgtttatgtatacagaagaaaaaaacttgaagaagatttaaagaaggacggagtaggtgagatattaaatatttacggatataaaaacactaatattgattatgcaataaacacattaaaagaaaggcttaagtttagcgataattttcctcatgaaataggtttgtttcttggttatccccttgaagatgttaagggatttatagaaaatctcggtaagaattcaaaatgctcggggtgctggaaagtttattcaaacgagtgtgaaaaaataaaaatgtttaacaagttcaataaatgcaaaaaagtatactcaatgctttttaacggcggcaggtcaatttctaaacttgctgttggcatttaaaataaatataagcgaggtataaaatataatgagtaaagtggcagttgtatactggagcggaacaggtaatacagaaatgatggctcaaatggttgaagcaggtattgttgaagcaggcggtagtgcaagtatgatgacaagcgcagaatttacttgtgatatggtagatgaatttgatgctattgcatttggatgtccttcaatgggaagcgaacaacttgaagaaagcgaatttgaaccaatgtttagagaaatagaagacaagttaagcggaaagaaaattgctttatttggttcttacggttggggagacggtgagtggatgagaaactgggaagatgagtgttcatctgacggtgccactatggcacatgaaagtgtaatatgctgtggagctcctgatgattcagctaatgaagatttaaaagctcttggaaaagctcttgtttaatttaaccccctaaaatatataattacttagatgcagaaacttttctgcatcttatttttgataacaatataaaagtcattaaatttaatgttttaatatcttataaataaaatattgtttttttttatgagataatataaaatatatagaaaacgtaaataaaatatataaatatatagaaaatcataaaaacaaaaatattgggagatttgtatgaaaacacatgaatccagagaagattatttggaaactatacttattttaaagaaaagacttggaaacgtaagaagcatagatattgcaaacgagcttaactattcaagaccaagtgtttcaagagcgataaaattgatgaaagaaaatgagtatataaccgttgaagaaaacgggctaataaagcttactgatcttggagaaaaagtagcaaaatctatttatgaaagacatacaataatcggtaatatgcttatgaaacttggagtaagtgaagaaacagcatttgaagatgcttgtagaatagagcatgttataagcaaagaaagctttgaaaaaataaaagaacatgccggtgatttcataaaagaataaatgtatatataaataagaagcaaagggtttttctttgttttttatttttttgacaaaagattatttgcaagtagttaaatattatgttaaaataaattgactttaacagacaaatagatatttgtgaagtttttttaggaggttaatatgatttatacacaagaagtagaaaacatgtgcgtagttaaaaaaggcgcaaatcatggccctgcacctattcctgaagaaggtaaatgggttaaatcaaaagaaatcaaagatataagcggtcttacacacggtgtaggttggtgtgcacctcaacaaggagcttgtaaactaacattaaacatcaaagacggtatcatagaagaagctttggttgaaacacttggatgttcaggtatgactcactcagctgctatggcaagtgaaattttaattggtaaaactttacttgaagcattaaacacagacttagtttgtgatgctatcaacacagctatgagagaattattcctacaaatcgtttacggaagaagccaatctgctttctctgaaggtggtcttgctatcggcgctggtcttgaagatttaggtaaaggacatagaagtcaaacaggtacttgctatgctacaagcaaaaaaggacctagatacttagaattatctgaaggttacataacagaaatcggtttagataaaaatgatgaaatcatcggttacaaatatgtaaatcttggcgttatgatgcaaaacattaaaaaaggtgtcgatcctatggaagctatcgaaaaagctagcggtaaatacggtagatttgacgatgcagtaaaaacaatcgacccaagaaacgagtaggagggaggaaataaaatggcattatttgaaagttacgaaagaagaattaaacaaatcgaagaagttttaaataaagacggtatcaaatcattagaagaagctaaacaaatctgtgatgataaaggtatcgatgttgcaggtatcgtaaaaggaatccaacctatttgttttgaaaacgcatgttgggcttacacagtaggtgcggcacttgctattaaaagaggagctactactgctgtagaagctgcaaaaattattggtgaaggtttacaagcattctgtattcctggttctgttgctgatgacagaaaagtaggtcttggtcatggtaaccttgcaagtatgttactttctgaagaaacagaatgtttcgctttccttgcaggtcatgaatctttcgctgctgctgaaggtgctatcggtatcgctaactcagcaaacaaagttagaagcaaagacttaagagttatcttaaacggtcttggtaaagacgctgctcaaatcatttcaagaatcaacggatttacatatgttcaaactcaatttgattacttcacaggagaattaacaatcgttaacgaaacagcttactctgacggcccaagagctaaagtaagatgttacggtgctgacgatgttagagaaggtgttgcaatcatgcacaaagaaggtgttgatgtatctattacaggtaactcaacaaacccaacaagattccaacatccagttgcaggtacatacaaaaaagaatgtatccaagaaggtaaaaaatacttctcagtagccagcggtggtggtacaggtagaacacttcatcctgataacatggctgcaggtcctgcttcttacggtatgacagatacaatgggaagaatgcactctgacgctcaattcgccggttcttcatcagttcctgctcacgtagaaatgatgggacttatcggtatgggtaacaaccctatggttggtgcaactgtttctgtttctgttgcaatcgaagaagctagtaaatagttttgttaaagtaaattaaaagataccttgtataaggtatctttttttatttctctataagcgcctatatattaaataagaattttaatttttttgaaaaagaatgatgtacttatgaaaaaattatataaattttatagaatctatttgtggaatataaaaaaatattataattaaataaataaaagtatctaaatcaaagggaaaacataaattttgcatatttaaagggatttatgaaaaaaatataaaaaatttattcaaaaaaataaaaatatactttgatttaggcggtttgtatgatataatactaaactgcaagatttatatttaggaggataaaatggaaacagtattattggtgttgataatagtatcaagccttggcttaattgcaagtgtagtattgcaagaaggttctactgcaggcatgggtggtgctatttcaggcggtgccgaaggtttatttggtaagaaaaaagctcatggtatgcaaggacttttaaataagattactttaatatcagcagtagtattttttatatcaatttttgtttttgaccttctaacaaaataaaacaatatagtaaaattaatttcggaggagaaaaatgagtgttgaaactttaaagttttttgcccctgttgcgggtattatagcgcttctttttgcgttatatcttgcttcttcgatcaataaagttgatcaaggaacagatagaatgaaagaaatttcatctcacattcacgaaggtgctatggctttcttaacaagtgaatacaaatatatcgttatttttgctgtagtattattcgctattttatttggcttaataggttgggaaacagcagtttgtttcttaattggtgctttattctcagttttagctggtttctttggtatgcaagttgctactaaagctaattcaagaacagctgcttctgctaaagacaaaggcatgggtgctgcattaaaagttgcttttaacggtggtagcgttatgggtctatgtgttgtaggtcttggtgctatcggtgttagtatcgtatacatgatctttgctgatgtaaacatcatcacaggttttggtcttggtgcttcttctatcgctttattcggtagagttggtggtggtatctatacaaaagctgctgacgttggagctgaccttgtaggtaaagttgaagccggtattccggaagatgacccaagaaacccagctgttatcgctgataacgtaggtgataacgtaggggacgttgcaggtatgggttctgacttatttgaatcatatgttggttctattatttctgctatgactcttggtggacttttacttggaagcatggaagctgttatgttcccattggctcttgctgcagttggtatcatttcttcaattataggttctttattcgttaaaggcggagaaaatgctgaccctcataagagcttaaatcttggtacatatgtaagcggtattcttgtaattatcgctgcttacttcttaacaacttctttacttaaagatattacatacttctatgctattatcgcaggtcttgtttgtggtatcttaatcggtaaagttacagaagtttacacatctgaagattacaaatcagttaagaaaattgctagtcaaagtgaaacaggtgctgctacaacaattatttctggtcttgctgttggtatgatgtcaactgctattccaattatcttaatcgtagctgctatcttactttcttatatgttatcaacagaaggtttatatggtattgctcttgctgctgttggtatgctttcaactgcaggtatgacaattgccgttgatgcttatggtccaatctctgataacgctggtggtatcgctgaaatggctgaacttgatgattctgtaagagaaattacagataaacttgatagtgtaggtaacacaactgctgctatcggtaaaggtttcgctatcggttctgctgctttaacagctcttgctttattcgcatcttactcaacagctgttggtatcaaagctattgacttacttgatgtaaaagttattgcaggtttattcatcggtggtatgcttccttatgtattctcagcaatcacaatggaagctgttggtaaagctgctaaccaaatgattgaagaggttagaagacaatttagagaaattcctggtatcatggaaggtaaagctaaaccagaatattctacatgtgtagaaatctctacaaaagctgcattaaaagaaatgattgttcctggtcttcttgcagtagtagttccattacttgtaggttacttcttaggtgctacagctcttggtggtcttcttgcaggtgcacttgtaacaggtgtattaatggctattcaaatggctaactcaggtggtgcttgggataacgctaaaaaatatattgaaggtggagctcacggcggtaaaggtagtgaagctcacaaagctgcagtagttggggatacagtaggtgacccattcaaagatacttcaggtccttcattaaatatcttaatcaaattaatgacaatcgttgcattagtatttgctccactatttatgtaatagaaaattaaagcctctttatagaggcttttttttattgtaattttagattgtattttaataatataaatttaatatatttttattgtagaagtagtgataaattaaagtaaaaattatatttaaaatttattattcgatttaacatattataaatggaaagtagtaagatatatttactattgtcattttattttagggttaaatttaattaatataataaaaaagactcaaaagagtttttttatttaatttctttatgtatattctttgtaaaagcaaagtaaatcctttgaaataaagaaaaatgcctttgctttttttgttataatccatatgttattttaaaacaaataatatttaaataattatttgatttgttaaatatatagttttaatgagaaatttagataataagttttgaacaaaattaattttataaaagggaaaagcatggaaaataacaatagaaaagaattaaaaaataaagaaatatggtataaaaggtggtatgtaatttatacttttctttttttagccttgtgtttcgttatttttttaccgttttttataagcggtaagagttttgtatgggatacgggagggcttaatacaggagacggatttgttcagcactttacatctgcagtatactttggtaattactttagagatataatacttaatttattaaaaagtcacgaactggttattccaatgtgggatttaagtatcggaacggggtatgacgttttaacatctcttaattattatgcttttggagatccacttagcattttctacatatttacaccggaaaaatttatgggatataccttttcttttgttatatttttaaggctttatttatcgggattatttttttcatttttctgttttaactttaaaatgaagaaaacgcctgtgattattggggcattatgctatgtattctgcgggtttagtttgtattgctctattcgtcatccattttttataaaccctatgatataccttcctttgcttcttttaggcattgaaaaagtatttaaaggaggtaagccttatttatttataataatggttaccataagcgctataagtaatttttactttttatatatgttaaccattgcggttattatttacgcttttataagagtaatgtatatttacaaagaaaaaggtgtatttttaagaaagcttttatattacttctttaaatttcttttttattatattattggtattctgctttcggcagttattttccttcctgttataatatccttttttaacagctcaaggcagagcggtcaggctaacaatctgacactggtttataatttaagttattatattaacgttataaaaaatatgtttgctgctaatgatatagggctttgggcatttttaggatttaatattataagtattatttgcggtgggattatatataaagataaaagcaaaaagggaaaatatttaaagtttatattaagcatttgtattatctctcttttagttccattttttggatatataatgaatggatttagttttgtgtcaaacagatggacctttgttttttcatttgtcatatcatttataagtgtttatgtaatgggagaattgaagaattttaaaaataacattaagtttataaatgtattacttggtgtgattttgtttttaaatatttctttgacagctttatatttatacttaggtaaagatataaaatattttttatttaactatatttttatatttatgggatttgttttcttgtttttgataaaaaacagaaagtacggtataaaaagaatatatatggttttacttattattgttcttatacaaattcctttttctgcctatataaaatattcgccttttacattaaattatcctaaagagtttaagtcttatgataagctaagcagtgccataaaccaaaaggaatttaattatataaaaagcattgatgaagaagaattatacagagttgatataaacaacaacaggttgaattatggacttataaatgatataaacggtctttcttcttatttcagcgttcaaaataataacagcgtaaactatttctttttaaccggtcaggttggacaggctacattatcgggtaatcacggttatgactgccaccttataagcaatgaacttaaaggagttaagtattttgtaggtaaaaattataatgccgatttgtataaagattacaaggttataaaggaatatgaagacagcaaggtatacaaaaacgaaaatgctcttgggcttttttatacctatgacagcgccatggatgaaaacacctttaattctttaaatgaatatgacagagaaatggcaatgcttcaaagcgtttatctggataaagacagtatagtttcaaatgatgatgttacttcttcttcaaagactttattagatttagaagatctaatggaaaatgcacagtatgacaaagacaaaatagaaattaaaaaggataaaataatagtgaaggaagatgacagtgaccttagttttaatatagatgtaaataacagcgaatgttaccttgtaatagatgattttgacttaaatttagacagtgaaattagtaaagatacttccttaaagagaaagataagacatttgctttatacccctgcaaaatattcttacatgaacataaaaattgacggaagcgaagagagttcttttagatattccataaaaacatctgataatacttattactttggtatagaagattatgtattgaatcttgggtattataaaaatgggttgcacaacataaagattaactttgatgaaaaaggagagtataatttttccgatatgaaagtagtatctcagcctatggatgattatgataaatatgtaaatgagttaaaagaagacaaggtagagaactttaccataaaaggaaatacagtaagtttaaaagtaaatacgaaagaagataaaataggggtgttatcaattccttattcaaaaggctggaaggcttatgtgaatggtaaagaagtagaaattttacaagcaaacattgactctatggggatagagttaaacaaaggtgaaaatgaggttgtgtttacatattgtactccggggcttaaagtgggggctattgtttcgcttgttacagcatttttatgtatgatttatatttttattaataaaaagaaaagaaatatttaaaacttatattaataaagcaacataagtttaatttaaactatttttaaacgaacatttattgtttttattaatttgacaaaatctttatatttgtatagaataaattacgaattttataaatttctaaattaaagaataaagagggaaacatgaatagtggtactatgtcattagttatacctgcatataatgaatctgaaataatagaaaatacagcgaaagttgttgtaaatatattaaaagaagcaaatataccatttaaagttctatttgtaaatgatggatcaaaagatgacacatgggaaaaaataagaaaaatatcaaaagaatatgattgtatagatggaatatgtttttcaagaaattttggaaaagaagcagctatttttgcaggacttcaatatgcaaaaggagactgcgttgctgtaatggatgcagatttgcagcatccgcctgaaactctaattgagatgtatcaaaaatggtgtgaaggatatgaagtaatagagggaataaaagcttcaagaggaaaagaaggcattgtttataaaataggtgcaaaaagtttttataaacttatttcagatgcaacaggaatagatatgtcaacatcatcagattttaaattaatggacagaaaagttgttgactcaataataagtttacctgaaagacatttgttttttagagctttatcatcatgggtaggatataagacaacatatgtagaatttgaggttcaggaaagaatcgggggagaatctaaatggtcattttcttctcttgttaaatatgcagttagaaacataacgacattttcaacagctcctatgcagatagtttcttttgcaggaataatattttgtattttagcaatagtaattgccattagagccgtataccaatattttgtaggaattgctcttggtggttttacaacagtaatacttttaatattgatacttggagctatcgttatgctatcccttggaataataggatactatatagcaaaaatctatgaagaagtaaaaggcagaccaagatatatagtatcaaaaacagcgaaggaagaagaaaaataggagaaaataatgatagaaaaaattaatggtttatatgaaaaatataaagaaattattttatatataatttttgggggtcttacgacacttgtaaattttgtaatatattttgtatttacgaatgtattatctataaattatcttgtaagcaattttatagcatggataggtgctgttatttttgcgttttttactaacaagaaatatgtatttaatgcaaataatacagaactttttaactatattaaagaatttgtaatgtttacctcttcaagaggattttcttttttggtggaaacatttcttttattccttggagtagaattgattaagttaaatgatggcatagttaaaattgcagtagctgtaatagtagttattttaaattatttctttacaaagtttgtatttaagaacaaagaggaaaaagaagaaaaaagagagatagtaaaagaaaataagaagaataatcttaaagatagtgaagtatggtataaaagatggtatgttgtgtatactgttttatttttagtttcagctttatttgttttccttccttttattgtaaccggaagattattaatttgggatactcaaggtatgaatgccggtgatggctttactcagcattatgcatccgcagcatatttaggtaattattttagagatataataaaaaatttaatctttaatcatgaacttataattcctatgtgggatttaacagtaggaacggggtatgatattttaacatctcttaattattatgctcttggtgatattttaaatgtattttatatatttacacctgaaaagtatacaggttatatgtattcttttcttattgtatttagactttatttatcaggattattttttatattattttgttttaaattcaataaaaataaaatgtctgcaattttaagtgccattgggtatgttttttgtggatattctttatatgcatcaataagacatccgttttttataaatccaatgatatatcttcctttaatattaattggagtagaaaatgttttaagaggtaaaaaaccgtatttatttataattatgataacaataagtgcaataagcagtttttactttttatatatgttaacaattgctactattatttatgctttaagaatgtgaagagtatatcgatataatcgaatttggaactcctcatgcttataataaaaaatatgaatcaagaaatgtaacattactatatcctcttacgccaaacatagataaaaataaaaaaatacgattttattcaaatgatggtgcaagaataaacgttgaatttatagatttatataatgttaaagattcacttaaacaaataataaataatatgaattaaaaaacactcttatatagagtgttttttattcgtccatagatactgttgactcagcagcaagaagtaaaagtcttttaaattcttttttttcttcttttgtcattttatttgtcattttatcaaagcatattttaacttgttcttttacaaatgggtaaacttctaaagctttatttgttggtttaatatcgtatgttcttttatcttttatgtttgtagtccttttaacaaaacctctttcttccattttatttaaagttttggcaactacacttttatcaagtcctattttttttgttatttcatcttgagtcattttttttaagtcacaaatgattaatataataacagcttgaggtgctgttaaatcatattttgcacaattcttgtttagaaacatatgagattttctatatagtatagatataaacttaaaagggttgtccataatatcaaacataaaaagcctccttttatttattaaatattatagttggttaatttaatatttgcaaatataatatagtggcaattgccactatattatattttgacaaaaaaggagtgcattatatggaaaaagttacaaaaatatggaataaaaattttattttattatttattactaatcttttggttttagcagctttttatgcttctatacctattattccggtatattgtcagcaaatagggataaccggttcaaaagttggtattgtactaactgctatgtcggttgcaacaattttatttcgtccaatagccggatatttacttgataactttaatcgttatcttgtatatgttttgtttttggcattgttttgcttatctttcccaagttttattttattcccaatgtttgcagcattaattgtaatacgtttatatatgggtgctgtttattctgtttgtggttccgcaacaatgactcttgccagcgatgttttaccaccttcaaagattacagagggaataagtagatttgcatttacaatctcaattggtatggcagttggtccttttgtaggtattcaagttcaaaactatttaagtagtaaagcatcttttcttacagtatttgcaataacggttgtagcactaatatgtgtgctatgctgtaaaatatcctaaagtagaaagaaagaaatttgctttaaaagatactatctacaaaccagcttttccatttatgtttaatatgatgtttcttatgattccatatggagcagtaatagcatattcatcaattttggcaggagaaaagaatttaacaggatttcttccttatttctatattttccttgttgtaggaatgcttttatcgaaactatctacacaaaagataattgataatggaaagcataaagtattagtgtatattagtttagtaattttaatattaacaatggttagttataaattcttaaacacaggtatacatttacttttagccggattcttctttgggcttgggtatggtatattacagcctttattccagtcatttgttacaggtacaacacctgctccaaagaggggagtagcaaatgcaacatatctattatcatatgatattggtattggtataggttctttattaatgggatttatgtaggaaagtataggattatctaatggtttcgctttaactgttgttgcttatgttataggttttatagtttacttattatatgtagataaatactatgaaaaattaaaaaacaaagaaggttcaaaaaaagaacacaaaggtttcttatcagaatatatggaacatgaaatatatactattgatgaaaataaaacggttagagatgccataacattctttactgaaaaaaatataagtggtgcacctgttatttcacaagatggtaaacctgttggttacattacagatggggatattatgagatatatgaaagtagatgagcatcatcctaccgctatggatagttccgtaatgtttatggattatttttggaatacagataatgaatttgaagaaaaacttaattcaattatggacttaaacgtacttgagataggtacgaataagcctattatgattgatattaatgcttcaatggaagaagcgttaaaattacttagtgaaacaggtataaagaaaataccggtaattaaggataataaaattgttggaataatttctcgtagtgtaatgacgcaatttttggttaagagatatcttgtaaaacaatatttgaaaaatagtaaaaatatgtaaatgataaagcatttttattgacttttgtttttttaaggtgtattattaattataattttaaggggattttagggggagttttgttatattttagtttttttacaaattaagtcaataaaaaaacagagaaggagatgtaattaaaaaatgaacaatataacaaaaaaggttaaagctgcaacaatgtctgctgcacttgaaaaatcattaagctacataacaaaaaatccacaagaaaatatacctaaattaatgtctatggttgataagattttaccagaaggctggtatgaaaaacaaagaaaagcttttagaggtgcaatagaaagaaaagacaactggtatgatttaatgttaagggtatgggatttggatgaaaatataagaaatacattttttaaaaattttgttataaatgcatgttttgctggaagtatgcgtcaagatgaggtaaaggaaaaagaaaactgtaatgttccttgggctatacttttagaccctacatcagcttgtaatttacattgtacaggttgctgggcagctgaatatggtaataagttaaacctttcttttgatgaacttgattcaatagttacacaaggaaaagaacttggtacatatatgtatatttttactggtggggaacctcttgtaagaaaagatgatattataaaactttgtgaaaaacattcagactgtgaatttttgagttttacaaacggaacattgatagatgaagcattttgtgatgaaatgcttagggttaaaaactttgttcctgcaataagcttggaaggctttgaaagtgcaaatgataatcgtagaggtaatggtgtatatcaaaaagttagaaagacaatgaaacttttaaaagataaaaaattaccttttggtatctctgtatgttacacaagtcaaaattataaagatgtaacgagtgaagaattctttgatttgatgattgatgcaggtgcattatttgtatggttcttccattatatgcctgtaggtaataaagctgcaacagaattacttttatcacctaaagaaagaacagatgtatataataagattcgtggatacagaaagacaaaacctattttttcaatggacttccaaaatgatgctgagtatgtaggtggatgtatagcaggaggaagaagttatttacatatcaatgcaaagggagatgttgaaccttgtgtatttattcattattcaaatgtaaatatacgtacatcaactttgcttgaagcattaaagagtcctttatttatggcatatcatgatggtcaaccttttaatgataatatgcttagaccttgtcctatgcttgaaaatcctgaaaaacttagaaaaatggttaaagatacaaatgctgtatcgacagattatgaatcacctgaaagtgttgatgcactttgtgataaatgtaagccttatgccgaaaattggaaaccacaagcagaaaaattattttatggaaatgaaaagtaaaataaatgtggtgtttatatgaaatcaactttacataataataaggtattttcaggaattgattctcttccaaatgctaaagcttcgaataaagtaacaaaaggctgtatagtattggaaggtggtgcgttcagagggttatatggagaaggtgtgcttgatgctcttatgttatctgatataaatttaagttgtacaataggtgtatctgcgggagcattaaacggaatgcattatgtttcagggcaaattggacgtgcagcaagggttaatttgaaatacagacatgatagaagatatattggttcaaatgctttaaaaaatgatcatggattggttggatttgattttgtattttataagtgtgtggatgcaggagcatttgattatgagcgtttttataattcagaaagaagatttgttgctgttgctgcaaattgtaattcaggaaaaacagtttactttgaaaaaaataaaagtgatatattccaggcaataagagcatctgcttctatgccatgtgcatcaagtaaggtttggattgatggagaaccttatatggatgggggatgtacaacaagtattccttatcagtgggcattagatgaaggttatgaaaaaataattgttgttagaaccagacctgatgactttagaaaagaaaaagattctgtaatcgagaactgtttgtgtaaaatgttatatagaaaatatcctaaatttttagatgtattaaaaattagaaatatcagctataataaagaatgtgacgaaatagaaaaattaaaaaagaataaaagaatttttgttattagtcctaagaagagtttggatgtacataggctagagccagatatggaaaaacttggtcattggtactatcaaggttacaacgagacaatggaacaattagaaaaaataaaagaatatcttgaaatttaaaaaaaacaccataaaaggtggtttttttatttatatataataattttaaaattaaataaaaattataatcattatatacatttaaagttaaaaaagatatttttatgaaaaaaacataaatatattcatgaaatttacaagtaaaaaagtaggaaatattataaaaataaaaaatataatgtttataaaagaagtttttttaaaattatataaaataaaaaagaggaaataattaaattattttaaatgttacaaaaatatagatacaatatgtagataaagaaaataaataaaaataaatatacaatatatagtggttaaaaagtaaaatataaaattttttttcttttagtcgtattttttacataaaatttaagacaaaaaaatataatactgctataatataaatacataaaaaaattaagcagatttactagtttcattatattattttttatgaaattttttaattaaaataaaatgcaagattataaattaaattttattttctcattctatttagttccttaaataatttaataaaaaaaaccataaaaaatatgatttattttttatggtttcgtaaaagttgtgtaaatatttgttatttatacaacctactcttgaaaaataataatgaaaacgttataattagcatatgaaatcgtttcacttttaaagtgtgaaataataaatatttaaagaggtgtagagtatgatagagatgctagaaaaggtaaaaaaatggaaggacagcgtattacttactgacagtgaaaaacagacacttaattcgatgagtgacgaagaattaagctcggctttttcacaagaattaaagtttggtactgcaggtcttagaggtataatgggacttggtacaaacaggatgaatatttatgttgtcagaagagcaacaatgggacttgctatgtatttaaacaaatactttgataatccaacagttgtaataagttatgacagcagaaataattcaagattatttgccgaagagtcaatgggagttttggcagcaaatggaataaaaacatatatgtttagtgaacttatgcctgttcccgcactttcattcgcaacaagatttttaaaatgcgatgcgggtataatgattacggcaagtcacaatccgaaagaatataacggatacaaggtttatgcttcaacaggtggtcaaatattagacgaaacagcagacgaaatagaaaccaatatagctggaatagatattttcgaggatgttaaatatatatcttttgacgaagcaattaatgggaacggagaatatgttccaaaagaagttatggatgcatattttgaagaagcaaacaaagcttcagattggtcaagcgaaagagatatttcaatcgtatatacacctcttaatggttcaggtaataaacctgtgcaacaaattctatcaatgaatggttttgataaagtatatgtagtgaaagaacaagaagaacctgacggtaatttccctacatgtcctgcacctaatccagaaaaatatgaagtatatggtcctgcaattaaacttgcaaaagaaaaagatgcagatgtaattgttgcaacagaccctgactgtgacagagccggtatgatgattaaagttggtgatgattatcaagtattaacaggtaatcaaatcggaatgttgcttgctgattacataagttcaagagttgataatccacaagataaaactattgtaacatcagtagtaagtactcctatggttgataaagtagtaggaaaatacggtgtaagcgttagaagaacacttgttggatttaagtggattggtgaacaaattgacttattaaaagattcatttatttttggatttgaagaaagttatggatatttagttggtcaatatgcaagagacaaagacggtattgttgctgcaaaattaatttgtcaaatggctgcttattataaagcacaaggtaaaacattatttgatgtactaaatggtttatataaagagtttggtcactgtgttgatataactgtaagcgttgatattgatgatatatcacaagtatcaagtatcatggataagatttcaacaaaagaaagtgcaaatgaagtatttttagatgtagttaaatatgaagattatagcaaagaaggaacagggcttcctataacaaatatgattttaattgaaaaaggtgacggaacaagggtaattgtaagaccttccggtacagaaccaaaagtaaaactttacatgtctttctatgaagatgatgaagctaaattagaagaaagaaaagcagatattttaaatcgctttaacacaattttataattttaggaggaatgataagaaatgagaatagatttatcaagaaacggtattgaaattaaacaggagtcaatggatattgcaagtaaatggcaaagtgaacttgcaaaaggagatcaagaatttacaggttgggcaaatcttccatcaacaatagataaagatatggttgaagatattaaacaaacagcaaaagaaataaaagaaaaatgtgatttatttgttgttataggtattggtggttcgtatcttggagctcaagctgtaatagatgctcttgatggaagcaaagaggattatcctgaagtaatgtttgcaggatataatatgtcagctacaacaatgaataaagttgtaaaagcaatggaagaaaaagaaacatgtatttgcgttatttctaaatcaggcggaactgttgaaccattaatggcttattcaattttaaaagaaaaattaattgaaaaatacggcgaagctgaagcagataagagaatatatgttgtaacagatgcagtaaaaggtactttaagacccgaagttgaagcaaaaggatacaaatcttttgttattcctgataacgtagggggaagatattcagttcttacacctgtaggattacttccaatcgctgcagcaggtgcagatattgatgcattattaaaaggtgctaaagatatggaagaagatgaaggctggaaagatgaacttttaaaatatgctatttcaagagttgaacttttaaacagtggaaaagttattgaagtatttgaatattttgaagatactttaagatatttcggagaatggataaaacaattatttggtgaaagtgaaggaaaagaaggaaaaggtgcttatcctgcatgcttatgcttctcaagagaccttcattcaataggtcaattcttacaacaaggtaatcctattgtatatgaaacagtaattagaatagatgaaccaaacttaaactttactattcctgaaatagcaggagatccatatgcaggaaaaactttagaagatattaacagatgtgctgaaggtggggttattttagctcatgaaaaagctggagttccaattaatactatttcaatagaaaaacttgatgaatacaatcttggacaaatgatttacttctttgaaatgacatgtggtattgctgcttcaatgcaaggtgttaatccattcgatcaaccaggggttgaaggatataagagtgaaatgagaaaattaataaatgaattataaaaaatatgaggtggcgcacaaatgtcaaaaactttattaacaaacgatgaacagtatttatttgcagaaggaacatatttaagagcatttgataagttaggcgctcatcctgctgaaatagacggaaaagaaggatttaattttggaatttgggttccggatgtaaaaagcgtaagagttgcaggttcttttaatgactggaacacagaagatttctttttacatgatgacggaaatggtgttttttctggatttatcgaaggaataaaagaaggcgagctttataaatttataattgaaacaaaagaaggcgagctgatatataaagcagatccatatgctttttactctgaagtaaaaccggcaacggcttctgttacaactgatattgagggatatgattggaaagataaacgatggatgaattcaagattaaaacacaatcatacaacaaaacctcttaatatctatgaagtacatcttggttcttggagatgtcacgaagatggaagctattatacttatgatgaaatgtcaaaagagcttgtagattatgtaaaagagatgggatatacacatgttgaaataatgcctgtgatggaacatccttttgacggttcttggggctatcaaataactggttattttgctccgacttcaagatacggtactcctaaagagtttatgcatcttgttgaaagtttccataaagccggtataggtgtaataatagactgggttccgggacatttttgtaaagatgctcatggacttggcgcattaaacggagataaagtatatgaatcaaaagaacatgcacaatggggtacatataattttgatttctcaaaaggagaagtaagaagttttcttatttcaaatgcactatattggattgaaaaatatcatgttgacggaataagagttgatggtgtaagtagtattttatatatgaattttggtatagatgatgaatcacaaaagaaatataatcctgatgggacggaaggtgacttagatgccattgattttgttcaaaatatgaataaaacaataggaacaatgtatcctgatgtaatgctaatagcagaagaaagtacggcatggcctcttgttacaagacctcctgaagttgggggacttggtttccattataagtgggatatgggctggatgaatgatacattaaattattttagaactgattttccatttaaaccttggaatcacaatttgattactttttcaatgatgtatacatataatgaaaactttattcttcccctttctcatgatgaagtcgttcatggtaaggcttcaataattgggaaaatgccgggagattattggagacaatttgcgggacttagagttcttgcattatatcaaatgacacatccgggcggaaaacttaattttatgggaagtgaatttggtcaatttatagaatggagatattatgaacaacttgagtggttcttaattgacgaatatgacacgcataaaaaacaacttcattatataaaaacattaaatgatttttatttgaaaacaaaatcattatgggttaaagattcttcttgggaaggttatacatggattgatgcagatgataatgaacgctcaattatatcttttataagacatggaaacagacctatagatgatttaatagttataataaactttactcctgaaacatataataattttatggttggagttccaaaagccggagattatgttgaagtatttaattccgacaatgaagaatttggcggttcaggagttgttaataaaagacgtgttaaatcgaagaaaaaagaatgtaatggaatggaaaattctataaaaataaaacttcctccaatcggcggtgtggtattaaaaagagcaactgcaaaaaaagctgcgaaaaaaacaaagaccataactaaaagcaaaaaaacagcgaaagctgagaaaacaacaaaatcaaaatagagagagagacaattaaataatggcggtttttaacaaaggtaaaaaaaatatcgaacaagaaaataatcagaataataaaatttttaaagataaagaagattttaaagaaagatatttaagtatttttaaaaaagaattaggtgcaagttttgaagaatcaaacagtattgacaggtacaatatgcttgcaactttaatccaaaaacaatctaatgaaattggtaatgattgtaaaaatggttatagaaacaaaacacaaaaaagactatattatttttcaatggaattcttaatcggaaaattactaaaaaattatttgattaattttggagttgaagatattgtaaaagaaggtttaaaggatttgggagaggatcttgacagtttatgtgaaaatgaaagagatcccggacttggaaatggtggacttggaagacttgctgcttgctttgtagattctcttgcaagtatgggatatgcaggttacggaatgggaataaggtacggatatggactttttaaacaagtaataaaagacggaaaacaagttgaattacctgataactggttggaaaacggttttccttttgaagccagaaaagacaataaagctgttgttgttaaatttggcggagaagtaaaaagaaattatgaaaatgataaattatattgtacatgggaaaatactgaaaatatcgttgctgtgccttatgatattcctatcgtagggtatggcggaaaaacagtcaacactttaagactttggagtgctgaaccttatgaacaaaaatttgatatgaatgcatttaataatggagattatgcaggcgcaatgaagttccgttccgatgtagaagcaattacaagtgttttatatccaaatgataatggtttatccggaaaaatattaagacttaaacaagaatatatgtttgtttctgcgggtattgctgatattatttctacatttaaaaaatggcatggaacggattggaagacttttcctgatacagttgcaattcatacaaatgatactcatcctgctctttgtgcacctgaacttatgagacgtcttattgatgaagaaggtttagaatgggatgatgcttgggatataacttgcaagagtatctcatatacaaatcatacaattcttcccgaagctttggaaaaatggcctattgacatgtttagacaattacttcctagggtatatgatgttgttgaagaaattgatagaagatatagagaaagttttcctagaaatattgaaaattggcaagagttacatcaaaatacagcgattctttggggtggagaagtaagaacagcaaatctatcagtaatttgctctcatactgtaaatggtgttgcggcactacactctgaaatattgaagaaagatacgttgaaagaattttataccttaaatccaagaaaattccaaaataaaacaaacggaatttctcatagaagatttttaagggaagcaaatccttcttattctaaacttattactgatgctatcggagataaatggttggaagatgcaaacgaacttgaaaaacttcaaaaatatgaagatgatagttctttccttgaaaagatggatgaaagtaaaaaagaaaataaagaacgcttggcaaaatatattttggatacatcaggtgttcaagttgatactaattcaattttcgatatacaagtaaaaagattccatgcatataaaagacagcttcttaatgttttaaaaatcattgatttatataaccagcttaaagaaaatccaaatatggatattcaacctacaacatttatttttgcagggaaagctgctcaaggatatgagtttgcaaaagatgtaatcagacttgtaaattctgttgccgatgttgtaaataatgataaaagtgtatctgaaaaaataaaagttgcatttgttccaaacttttcggtatcaaacggacagcttatatatcctgctgcaaatattagtgaacaaatttcaacagcgggaatggaagcctcaggtaccggtaatatgaaatttatgatgaatggtgctattacccttggtacgttagatggagcaaatgttgaaatttgtgaacgtgtcggaagagataacatagaaatattcggtttaaaatccgaagaagttgatagttataaattaaatcataattattatgtatgggatgaatacaataataatcaaagaataaaaaaacttgttgatgagcttgttgatggaacttttggtaaattatcagggaatttcaacttgatatatgatactttacttagaagcaatgatgaattctttgtgcttaaagattttgaatcatatatgaacggatggaataatttacaaaaactttatttagatagaaataaatggaataaaatatctcttcataatactgcaaaatcaggttatttctcaagtgaccgtactataaaacaatattgtgaagaaatatggaatataaaaaataatctataaaagatatagataaaaaggagtttaattaaatatgagaaaaaacgaatgtattgcaatgcttcttgcaggaggtcaaggtagccgtttaaaagccttaacaaaaaacattgccaaaccagccgtatcttttggtggaaagtatagaataatcgacttttcattatcaaactgcgcgaattcaaatatttcaacagtaggtgttttaacacagtatagaccttttgctttaaattcatatataggtagcggagctgcatgggatttgaatggaagagaaggcggagctttcattcttccaccttatgaaactcaaacaggtggagcttggtatgctggaactgcagatgctatatacagaaatatagaattcataaaccaatatgatgcagattatgtattaatcctttcaggggatcatatttaccgtatggattatgaagatatgttaaatactcacaagaaaaatgaagctgatttaaccgtttctgttaagccagttgaatgggaagaagcttcaagatttggtattttaactgctgatgaagaaagcagaatcgttaaatttacagaaaaaccaccaaaaccggattcaaatttagcatctatgggaatatatattttcaataaagatgttttacttaaagctcttgttgaagatgctgaagatgaaaattcagaccatgactttggtaaaaacataatacctaaacttctttcagaaggtaagagattatatacatatgaatttgatggttattggaaagatgttggaactgttgaaagttatcatgaaacaggtatgggacttcttgaagaaaaacctgaatttatattggatgatcctactgctcctattatgagtaatactaatatatattcttctcaagtaattggtcctaatgctgatattcaacaatcattggttgcaaacggatgtcacataaaaggaacatgcgaacactctattatcagtgtaggatgtacagttgaagaaggtgcatatgtgaaagattcaatattattacctggtgttacaattgaaaaagaagctaaagtatttaatgcagttgtaggagaaaattcagttgtaaaacaaaatattgttttcggtagtgatgaagaaggtgctgaaattcaattgataggtaatgatgaaatttatagtggtggaggagcagaataatgaaaaatttagtaggtattataacagcaaattatggaacaccggacttaaatattttaacaaataaaaggacaatggcttcacttccttattcaggcagatatcgtttgattgatttccctctttcaaatatggttaattcaggaattaatacaataggacttatacaaccagcaagatatcgttctattattgaccatgttggaagcggaaaagaatgggatttggataaaaaaagaggaggacttcatattcttcctggaacatcttatggtataggtgtcggaaatgaaaaatttgttataagagattttagaattaatgatgtgttctttaaacgttcaccttccccatatatagtaatttcttcagcaagtattataaataacattgattatacacagttatataaagctcacgttgaaagcggagccgatataacaatggcttataaagtaatttcaagtgataatgaaaatatactaaaaatagaagaagccggcggaaaagttatagatgtagttaaaggtgttaaaaaaggcgataaagcatttattgaatgctttataattaacagagcaacactattaaatatttttgaatggttcaatgaaattgactatttagatttatttgaagcattaaaaggttcttataataaattaaatgtaaaaacctttgaatatgttggatattcaagatgtattttcgatgttgattcttattttgaaggaaatatggatttacttaaagaaggaattgcagaagaattattcaaatcaaattcaagaattcttacaaaagttcaagactctgcacctacaaaatacgaaagaggctgtcatgtaagaaatagtgttgtaccggcaggttgtaaaatagcaggtactgttgaaaacagtgttattttccgtaatgtaataatagaaaaaggtgctgttgtaaaaaatagtattataatgcaaaattgtgtaattaaatccggagcacagatagaatatgctataatagataaaggaaatattatcggagaaggtttaatgattaaaggaaccagtgatgatattttcattaaagaaaaaaatgaataggatataaggtaatggtgaaaagaaaattaaatgtattatttgcagcttctgaggcttatccgtttatgaaaacgggtggccttggagatgttgctggatctttgcctaaagcattacaaaacgatggggttgaggttcgtgttattattccaaaatacagagatattccacaggaatataaagatcaaatggaacatgtttgtgatttttatatgcctcttggctggagaaacgtattttgcggaatagaaaaattaacatatcagggagtaatttattattttgttgataatgaatactattttaacagaggcggagcatatggctattttgatgacggtgaaagaattgcattcttctcaaaagcaatagttgaatgtttacagtatttacctgattttaattgtgatgttctacattgcaatgactggcatactgctttagcacctgtattccttcgtgaattttataacggcgttggaaattatgataacgtaaaaactgtatttactgttcataatttaaaattccaaggacaaatgtctgatatggttcttggagatattttaggtcttgataaaagcaaacctgcatcggaacaattaagaagtgatgctcagtcaattaacttcttaaaaggtgctttatgttacagtgatattttaacaactgttagtgaaacatatgccggtgaaatacaaagtgatttcttcggcgaaaacatgcaggatatttttagaagaagaaataatgtactatatggtatagtaaatggaattgatgttgacttctttaatcctgaaacatcaacaaatattgttgcaaattattctgcggacaatttagaaggaaagaaaaaatgcaaagaagaacttcaaaaagaattaggacttgaagttaatgctgatgttcctttgattgttatgattggaagattaacgcagcaaaaaggtcttgatttgattcaaagaatattagacgaattaatgcagcaagcagttcagtttgccgttctaggtaccggtgattacgaatatgaagaaatgtttaaaggtttctcttataagtatccgggaaaagtaagcgctaatataagatttagtgaacctttaagtcatagactatattcaggcggtgatatgcttctaatgccttcattgtttgaaccatgcggactttctcaaatgatagcaatgcattttggtactcttcctatcgttagagaaacagggggcttaagagataccgtaaaaccatataatatgtatacgggtgaaggaacaggttttagtttcgcaaattataatgctcatgaaatgttgtttacaataaaatctgcaatagatttatattataacaataaagatgcatggaaaaaaatgcaggaaactgcaatgaaaacagactttagctggaatgttgctgctgataaatataaaaaattatatgaacagcttcatcctgaagtagagccatatgtggttgaaaaaaaggaagaagaaaaagcagttgaagaagaaaaaccggttgaaagtttagataagcaggaagaaacggttaaacctgaagaagaagtgaaggaagcagttaaggaaaaagtaaaagaagaaaaagttgtagaaaataaagaaaatgatgtaaaagaagatgtagttttaaaagctgatgtaaaagaagaaaaagcagaagttaaaaaagaagaaaaaacagaaaaagaagaagttaaaaaagaagaaaaaactgtaaaagaagataaaaagaatatttcttcaacaacaaaaaccgctaaaaaacaaacaagcacagcaaagaaaactgcttcaaaacctgcaaacaaaacaacaagtaaaactgcaggaaaaaccaggaaaacagctgcaaaaaagacaacttcttcaagaaagacagtaaaaaaagatagtgatactacagctaaggctaaaactaccgcaaataaaactgtaaaaaaagaagacagtaaaactgcaagtaaggtaaatacaactgaaaaagacaataataaaaaatagcaaaagggaaaatgaaatatgagagcatatcataattctagaaacgaaatttatagaaaacccttcggtgccatctgcataggtggcactgtttctgtttgtttagacatatttgaggaagaaaatgcacaagttaaattaagggtatggatagacaaaaagggtgaaagtatttttcaaatgcaagaagaaaaaatagatgattatgtaagacatagtttcaatttaaaatgtaatgaagcgtgtataatatggtatagtttcatcattgaaaaacaagacggaaacaaagtttattatggagcaaaacaaggaagaacaggaggagaaggtgcattatattcttatgaacctccttcatttcaaattacagtttataaagaaagaaaagttccaagctggtataaaaactctgtggtttatcaaatttttcctgatagatttaataggggaaaagattttgaaaaaagagttaaaaacttagaaaagaaaagaaaaggccctgaaagaaaacttgtatatagttggaatgataaacctaaatatgataaagatgaacaaggaagaattaaaagctgggagttttatggtggaacattacaaggtattgtagaaaagcttgattatttaaagaatttaggaattacgtcaatatatttgaatcctatattttctgctgcaagcaaccataggtatgatactgcagattataatcaaattgatgagcttcttggtgatgaggaagattttaaatatttatgtaaagaggcagaaaagaaaggtatttccattattttagacggggtatttaatcatacaggatgtgatagtatatatttcaataaatatggaaattatgatgaaaaaggtgcattccaaggaaaagaatctaagtattatgactggtttaattttaaagaagacggtacttatgattgttggtggggtgtggatgatttaccaaatgtgaatgaaagctgtgaaagttatcaagaatttatatataaaaatgaagacagcataataaaaaaatggttacaattaggagcaaaaggctggagactcgatgttgcagatgaacttcccgatgaatttataaaaggaataaaaaatgccgtaattgcaaaaaaaggtaatgatggggtacttatgggtgaagtttgggaagatgcaagcaataaaataagttatggagaacttagaaaatactttcaaggtgaagaacttgattgtgttatgaattatgtgtttagagatggtattgagaactttattttaggtaaaatctctgcttatgatttggcagaaagtttaatgagtttatatgaaaattatccaaaagagaatttttattcctctttaaacttgcttggaagtcacgatagaatgcgtataatgacacttcttggagacgctgttgatgaaaatacattaagtgaagatgaaaaaagagaatatagattaaatgatcatcaaagaggtatagcaaaaggaagattatggcttgctgttttaacacaaatgttgatgcctggagttccatgtatctattatggagatgaagcagggcttgagggatattctgatccatataacagagcttcattcccatgggaaaatatagatatggataacctttctatttatagaaatgcaatatctcttagaaaaatttatcctgtgtttataaaaggggattttgatcctgtagcattcaatgatgacgtctttggattttatagaaaaaatgataaatcaaaagcccttttattaattaacagaagtttatcaaatgtttatgatattaaaatcaaagaagattggaaagctaatgatattgtaacaggtgctgatatgattaaagatgaacaaggatattataatgtaacaatatatcctttaggttcgtccgtaattcattttagaaatgacaatgcactttgcgtagaaatggaaagaggaagcggagtattatgtcatataacttcaataccaggaggaaaattaggtaaaccggcaaaagattttgttgattttcttgcaagagcaaaacaaaaatattggcaaatactacctgttaatccaacagatgcctttggttcaccatattccggacaatcagcatttgcaggaaatattaatttaacgggttattcaatttcagagcttaaaaataaatataaacattttaataaaaaagatagtgattttattaatttcaaaaaagaaaatgattattggcttgatgcttatgcgatgtatatggcaataaaggatgttgaaggaaattatgaaaatcataaaaaatattctatagagttatataaaaataaaaagctaggaaaaagagctgatttttacaagtttactcaatttgtttttgaacaaatgtggcaggatttgcacagttatgcaaatgaaaaaggaataaaaataataggtgatatgcctatgtatgtttctgcttcatcttgtgatgtttgggcagatccagaatattttactgtaaatgaaaatggagaaattgaaaaagaagcaggagttccgcctgattatttttctaaagaaggtcagctttggggtaatccattatataactgggataaaataaaggaagataattattcttggtggttaaaaagactaaaaagagcaatttcactttatgattttacaagattagatcattttagaggatttgaggcttattggtctgttccaaaagggggaaaggctataaaaggtgaatggatacttggtgttggaactgaggtatttgaaaaggcttatgaagaatttggagcattaccgtttattgctgaagatcttggaacgattactcctggagtaagggctttacttgaaaaaacaggtttccctggagcagatgttattcagttttatgataaagatccagaaaattatgttccgcctttaaataaaatagcttatagtggaacacacgataatcaaactcttaggggatggtgtatagccaggtattttggcggtaaagaaaatgatgaaaataaaaaatatattgatgaaaagatagaaatattaaaagataaattatattcttgccgaagcaatattgttataatgcctcttcaagatgtgttagatttaggtgatgaatcgagaatgaataaacccggaacagttgatgaaaactggaaatggcaggctttaaaagaacaattagaaggttatgatgagaagttaagaaatttaacagaaaaaaataacagataaaaaaatacccatatgggtattttttatattaatattaattttgcagccccacaaattccggcatcgttacctaaacttgcaagttcaaactttatatttctatttgcaaaatatgcttttttgtcaaaatatttctttacatattctattataacatttcccgcttttgatacgcctccgcctattaaaataatttcagggtcaattattactgcaatatttgcaattgcgtatcctaagtatttaccaaactcttcaataacttcttttgctatttcatcgccatcttttaaggcatcaaaaacatcttttgaagttatgtcatctttattaagaatactttttatatttgttttttctaacttatttttagctaaatttacaattcctcttgcggaagcatattgttcaagacaaccttgacctctacaaccacagtgtttatcttcgttgtaattaactttcaaatgtccgatttcaccgcctgcaccatttgaaccaataagaggtttaccgtttattattattcctcctccgacaccggtgcctaaagttatcattatcaagttattataatttttacctgaacctaaccacatctcacctaaagttgccatgtttgcatcgtttcctgtctttattttaaatcctgttagttcatgtaattctttgataacttctttatactcccaattaagatttgctgaacctcttacaataccttcttcttttattggagcgggaaccccaactcctgcgcctaaaatatcttttttatttatttgtttttcattaattttatctaaaagagattttgaaatatcaggtaaaatatatttacctccttcttgtttacgtgttggaatttcccatttatcaactatcgttccattatcttgaaataaacctatttttacggttgttccgcctatatctacaccaaagcagtaattcattttttctcctatctaaatattattttcaattatatattttagtccaaatgccattactttagagtcttttatttcaccatttaaaatcatattttttaattctttttttgaaacttttactatatttataaattcatcttcatctaaatcttgtttttccttaacttctaaatcgtcacaaataaaataataaataacctcatcagaatatccgcttgcaggataagtttcgccaaaaggttttatattttttgctatatatcctgtttcttctcgaagttctcttaacgcagcttcttttatgtcttctcctttttcaagttttcctcccggaaactcaagagtttctgattttacagcttgtctgtattgttttattaaaattatttctccttcttttgttatgggaatgattgaaacagcaccattagtttttattatctgtcttttagcggtttcgttatttggaagtaaaacttcttcttgagctatatcaaacaccatgcctttaaacactatatcagttgaaattgttttttcttttaaatccattttattctcctttacttttaaattatactataaaaatagtaatttataagaagaaaattaataataaaaaaggtaaaaagcttaatttaagctttttaccttagatgtttttataaagaaaaatcctccaataacaaacattacagcaagaattccaactcctgtattaatgtttccacttatttggcttaccaaagataccaagaatgttccaagtattgaagcaccttttccgcaaatatcatatattccaaaatattcacctgatttattttttggaattattgatgcaaaatatgaacgtgaaagagattgaattcctccttggaatgctcctacgcaaattgcaagtatccaaaattgatattgaagtttcatagtcattccatataaaactatgaagaagtatgctgttatacatactaatattaatttaaacacatctgtttttgtgcttaatttcccaaaaaacaaagcagtagggaatgcgacaatttgtgttacaagtaaagctagtaataaaccttcggattttaaaccaagagcggtaccatatgcagttgccatatctattattgtatatacaccgtctatatagaagaaaaaggctattaagaaaaacagtacttttttatttttctttagctcgttaaatattttagataaccttataaaactttcttttaatgggtgatgtgttggttcaacataatttttttgtttgtattttctccataaaggcattgcaaatagaatccaccaaacagcagtgattagaaatgccaaaaacatagcaacttgtattgataaaccgattttatcatagaataaaactactacaagagataaaataaatggaatacaacttccaatatatccccaagcatatccacttgctgaaactctattcattttttccggggctgtaacatcggtaagcattgaatcatagaataccaagtttatagagtatgctgattttgcaaatacaaataataataaaaaccatatccatgattgaattattccaagaagaacacatccaactgatccaattaacaatgatacagaaaaaagtttctttttccatcccggaaaatctgatattgttccaaaaaatggagcaagcaaagcaactattattgttgatattgttgttgcatatccccagtatgcaaggtagtttacttctgagataccttgcgagcttgcaagttggttaaaatatataggcattattgttgtaacgagcattgtaaatgcagagtttccaacatcatataaaacccatttcttttctatttcattaaatttcgatttcatactttttctcttcctccaatgataatactaaaatgtcctgccaattttcgtttggtccaaaagttttgtcaaatgattttgataaagaagtattattatataatttatcaattaaaatatttgtgttttctatacacttatttattgaattattcattatcttttcgagtcttaaattactgtcaaggcaaagttttattggttctttttgcattcttaatttatttttgcttttatattgtccgcttatataaagaacgaaagaaacaagttctctttgccataaatgtgcaccaagtaaaaaactatcgtaaaaagatattgaatttatagaatgaaaaatttcatctggagttatacctttatagaatgctgaaattattttactgttttctttattaatatttatccaatttaatctttgttttttctttggatcgatattattctttttcattaaatatctctcaaattcccattctatgtcataatgagttactttacttgtatatattttgttttcaatatatccatgagcattgctatcaaaagtaaaatgacataaaaatcctagtaaataagataaatatttattaaaattttcttcttctatggaatgtagagtatctattgcactgttaaaaaatatacttcctttttcatcgtgcatatcatttccaaattttgtaacattatttgattttaaaggtttgtaataaaataatatatcaggtccttgtaaacctatattaaataaatctttgttttcaattactatattttttatttcttttggatatttgtctaaaactttttgtccaaatatgtagtgagctgtaattccaggcaaaattaaaacctccaaatgctatatttaatactttatcataaactaaaaattgattgtatataaactgaaaaaaatattgatatttttcaaaaattttacatttgaaaaagataaaatgtaaatatatgttatattatataataaatattaaattaataaaataattttaggagaataaaatgggtatattacaaggattaaaaattttagattttacaacacttcttcccggaccttatgcaacactacttcttgcggatatgggtgcagaagtattaaaaataagcagtaaagatagatttgatttggtaactcattggcctccgattattgaagattcagatattactgcttctgcagcatggcttggaagaaataaaaaaagtatatacttaaatttaaaaaaagaaaaatcaattgaagctgtaaaaaaattaataatggaatatgatattattattgaacagtttagacctggtgtaatgaaaaaacttggactggattatgatactttaagtaaaattaatccgaaacttatctactgttctttaaccggatatggtcaaagtggtgagttaaaagatagagcaggtcatgacataaattatttatcaagaagtggtttaatggcttcttcaggcaggaaaaaatcaggaccatctctttacaatatgcaagttgcggaccttgcgtcgggttctatgaatagtgttgtttcaattttagcggcagcttataatcgagaaaaaagagggattggagaatatatagatatatcaatgcttgatggtatgataccttttaatacgatggacggaatttcgttcttaacttcaaatatagcgcctaaaagagaaagtcaagtattaaacggcggaggtatatatgatttttacgaaacaaaagacggagaatatattagtgtagcagcattagaaccgaaatttttctataacttatgtatggctttgggatatgaagattgggctgatggtaaaattttaaaaacagatacaaaacttgtaaaagaaacattaaaagaaaaatttaaagaaaagacaaaagaagaatggagtatattttttaaagatgttgatgcatgtgttgaacctgtaatgtctttaaatgaaacaaaagaagataaacatctaaatcaaagacagatgtttgttgaaactaaacttcctcataaaaaagagataaaagtaaaacaggttgggtgtccaattaagtttttaaatagtcctgttgaatatgaatatgcaggatatcctgaaggatatcatactaaagatgttttaaattatttgggatatagtgatgaagatattgaggatatgatttaaaaagatattgcttttgcagtatcttttttttattttataaaaaatttacaaaccttttaccgaaaaggaaaggtaacaatattttacattatgataaaatttaaaatattatataaaaaggagactaatgttttggaatatcctcaaatagaaaagtatgaatataaaagtccaagttatgaactaaagaaaagagaaaatattaataaaaatattgaaaagcatttaaatataagaagatttgtcttatctgatgataataaatgttttaaatctataaaagatagtaaagatgaaatatctttaatttttacaggtgatttattatgtttagaaaacatgattgaaaaatattctaaaaaagatggtggatatgatttttcattatgttttaaatatgttaaacctatttttgaaaaagcagattttgtttgcggaaatttagaaaccgtaatatcgcaaacagctccttacagaggtgaaatattaacacatgaaggaccatattattgcaatgccccatatgaatatttagaggctctttctttatgtggttttgatatgcttacaactgcaaataatcatactattgatgcaggtgtaaggggaattgtagatacaattaacaatataaaagatattggtattattcaaacaggtacatttttaaagaaagaagataaatttgtaattgttgatatatgcggtataaaagttggttttacagccttttcaacttcttataataaaatgcagcttaacttaaacagacaaggcagaataaacttacttaatacttatactcaaaatagagctcaaagtgtatttgataaaatgaaagaaagaggagcagaggtaacagtatgttttcctcattggggaaaagaatatacttctgaaattacacaaagacaatattcaatggctgaaaacttatctaatataggctatgactttattgtaggttctcatgcacatgttattcaaaagtttgaaaaaataaatgataaacctgtacttttctctttgggaaatttaatttctcatttaaatacttttgctgattcaaatttttcagagtacacacttctttataatttaaaattacgaaaagaaaatggacaaataaaatcaaaaattgaatttattccatgtaaaattgtaaaaaattataaaggaattccatttactgtattacctattgtagaatctttggggcttacggaggaaaaagttccaatgcttaaaaatacatatgaagatgtaagtaaacttcttgaaaataacgaaataatattaaatacaaatatagaagtttcttcaaattcaatagatgatttaagaaaaaatgaagataaagatataaatgaagtacttaatattttaaaagacaaaaagaaaactataagtaaaaacagatcagtaaaaataaatattcctgaactaaaagaaaatgataattttaattattataagaaagaaaaagaaggaatatatgaaatatatgacgattatgctgttcttcattcttttttaagtatgagcagtgtagttaagctaagtgaaaatgtagatggtaaaactgtatattatgtaaacaatgatctagaaaaaaatgatagtacaagactagtttatttgggaaaacaaacaaagataataggaaaagaagcttttaaaaattttacaaacttagaaagtgtaagattttttgatgaagtaacaaagatagaagaaaacgcatttgaaaattgtataaaaatgagtggcttatggcttccggagtcattaaaatgtattgaaaaaaatgcatttttaaattgtgaaaatttattaagtattaagataccaccatcagttacaagtatagataaagatgcttttgttggatgtaataatttaacaatatattgcgaaaaaggaagttatgcagataaatttgcaaatgaaaatagaatatgtgttaaatatatgcctttaataactaaaaaggataataatataagtttaaataaagaaatagtaggaacaatgaatggacctaatgataaacatccagctactattatttcaacatgttatattttgggaacacctcttccatattatgcaaaatgtaaaaatcaaccttcaaaatatataaaatatagagcttttgatggaacacttgaaagtatagttaaattacttggaagtaaaatgcctgaaattgataaagaggaacttaaaaagaaatataagtcttttaagagaaaatataaatcacagaaaaatttaaaatataacaatgtaaatcttacagtatatttttgtgattggttattatattgtagccaaagaggatttactcataattgttattttgattatgaactttataataaagagcctgatataagagatacatttttaaatgaaggatacagaaagagagttcacaaagcttgcaataaaaaagaatatagaaaaatattcttggataaagcattgtttaacgaaacttttaaaaagtatgtaaaaagagattggcttgatgtaagctgttgttcttttgatgaatttaatacttttataaaaaaacatgaagaattttttgcaaagcctgtaagaggaactggtggagcaggtgcaagagttataaaaacaaatgatgatacagctcaaaatttatttgaactttgtaaagaagaaggtttgataattgaggaaataattaaacaaaatagggaaatagcaaagtttaatgaaagtacattaaatactgttagagtttatactttagtatgtgccgataatacagcaaaagtaatgggtgcagttgcaagattcggaagagccggaaatgttatagataactttcatggtggtggagttgctgcaacaatagatgttgaaagtggaaaagttaatcaagcaataaatagagcccatataagaacagatatacatccagattctaaagaaaagattttagggtttaaatatccttactgggataagttaaaagaagcagtatgtgatgctgcattgaaagtgcccgaaatgagacatattggttgggatgtatgtattacggaaaatggagatattgaatttgtagagggaaatggtaaacctaatttcgatgtattacaatctccagaccaaattgggaaaaaacatatttatgaagataaaataagagaaattgaaaatatagaaggaataaatcctattgtttatgacaagataatgataaatacaaaaaatatggagataggatttatcagaatgcttccaaggagattaaaaaggaaaataaagagattaataaatagataaaataaaaaatatccttaacattatgttaaggatattttatttaaaaaattaaagtaaaacctttatttctattatgtaaattaaatgtataaattaatatttttaatatttttattgatataattagtctaaatttctaagaggggaacaatggtaattgtaataaagttaggaaagaaatttatcaatatagtttattattttataaaaaaatttaaccctataaaagaaaataaagttttatttttaagcaggcagtctaatactttaagtttggattttttactattacaaaatgagcttattaatatgacatcaaatagaattgaaataaaatacatatgtaacagattagatgataataaaaaaggaataattaaatttattatagattcctttaaaagtatgtatcatcttgcaacaagtaaagtttgtgtattagattcttattggcctattgtttctatttgtaagcataaaaaagaattaacaataatacaaatgtggcattcaatcgggaaaataaaaaagtcaggtcatcaaactattggtaaaccttcaggaagaagtgaagaaatctctaatcttttatgtatgcatcaaaattacgacataattatttcatcggcagaatcctggaatccattttatcttcaatcttttaataccagtttagataaactttataacataggtcttccaagaatagattatctattgagaacaaatgaatttaataaagaaagaattttagatgaatatccttttttaaaagaaaagaaagtaattttatatgcgcctacttttagaagaaatattattcccaaatgggaagagcttttagattatatagattttgataaatattttttaattgttaaaagtcatccaaatcaaaaaataaatacagataatccaaatattttaacttgtcctgaatttagtgcagtaagacttctttctgtttgtgaatatttaattactgattattctgctattgcggtagaagcagcaattttaaataaaaaaacttactattatctttatgattatgatgaatatttattaaaaaacggagttaatgttgacccattttattcaatgccgggatgtgcttttaaaaatgcaaaagatttgattatggacttagaagcaggtaattataatcaaaattctcttgataattatagagaaaaatatttaccaaaagaacttggaacttctactgcaaaacttgcacagttagttttagataagttgtcatagaaaagagaggaattatgtttgaacttgcaaagaaaattttaaaaaaaataaaattatttgttatatatttcagaagaattatatttgtaaaaaatcattttaaatgtcctttttataaaaaaataagagcaaatcttaccagaggttttttagcagatcaatggatgttatatgatttagatcacaatgataaaaacgaatatttatctgaatttgattggtataggtcaagatatataaatgaaccttttgattttatgtttaataataaaattgtagcaaacgaagtgttgaaacaatatattaaagttcctgaaatttatatgataaaaaataaaggtattttatctatttttgatgatagtgaagtggactatgactatgcattaagacttcttaaagagcataaaaagttatttataaaaccttatggagcaggaaaaggaaaagatgttaatattttaacttatgataatgaaaaaatttatgtagataaaaatgaattaagtgagaaacagtttgtttcttttttgtttaaaagggataattggataatcgtggaatgtataagtcaacatgagtatgcaaataaaatatatgataaaacagtaaataccattagattaattacgttaagagatattcataccaagaaaataaaaatcttctttgccgtacagagaataggaacaaagaagacaatacctgtagataatggaagcagaggaggacttgtttcaaaaattaatttagaaacaggagaattatctgaagcaagatgtcttcataacttaaatgtatataaggttcatcctgattctaaggctcctatagaaggagttaaaattcctaattggcaagagttaaagaaagaaattttagaacttgcaaataagattccatatatgcactttatagcttgggatattttattaactaatgaaggaatatgtattattgaagcaaatacatcctcaggcgtaaatattatacagctttggggagggcagagaaataacgaacttggagatttttacagatatcataatgtaataaaatagaggtgatatatgaagtatataataatggctgatgggaaaggaaaaagatggcataattacaaaaatattcctaagcattttatagaagtaaatggtgaaaagattatagaaagaactgtaagattattaaatgaatttgataaagacagtgaggtaataataacttctcatgatgaaagatatgaaataaaaggttcaaaaagatatgaacctaaacataacattttagaaattgatagatttacaagtgaacttatagaagataatatatgttttttatatggagatacatattattctgataaggcaatagaaaaaattataaaaataaatactgatgatttattgttttttggtaatggtaaatctattgttgcaattaagataaaagattcaaatgtgtttactaagcatgttgagaatgtaaggaaattatatttagaaggtaaaattgaaaagtgtataggctggcaggtgtatcaatcatttcaaggactttcttttgatgaaaaagaaataaaggataaatatgtttatattcaggacgatacacaagattttaattcaccaaaggattatgaaaagaataagggggtacttatataatgtcctttaatgacataaagaaatacggattaaatattttagcttttccaaatacttcaaaaggttttacaggggcagaagcaagaaaatggataagaggagtatatagaagttatttaaaagataaagattattcttttagagagacaagatgggcagtaaaaaggggctttttacctgaacaggtgaaaagtttaaatataaacgaagaaaattataaagatattatttcagcaaaggattatgcttttttaagaccaattaatggaatatatggtaagtggatatcagataaggtaacaatttataatatttttaaaccatttagggatagaatgccaaaatgtttttatcatattacaaacagatataaagataaacttattattcctcttaatgtaaataaaaatgatacatggaaagatgtaattaatacgataaaagaagaaaaaaaggttaggttatatatctcaaacagacatcaaagtgattttattgaatgggaaaataatagtttttatattaatgaaaaagaagtaaaagaaaaagaattaattgattacatttcaaaaattaataaaagtgttattattaccgaagatttaattcaaagaaaagatataatgttaaagttcataagaaaagagatagtttaaactatctcttttgtttttataaaacgtaaataatatattattccaacaaccattggaataataggggagatgaattctgcaatatatattcctatgaaagataaattaaatatttctattaatattatgcttaaggaaactcgtattataactgcttgaagaattgagtttagcattgccgtaaaggaatctgatactcctgtcataaatgaatccataatatacattactgcataggatataaaatttattgaacagcatattcttaaatattttactccttcacttataacctttatatcagttgtgaatatgcctataattttataagcatatatttggaaaatcataataagtataaaacaacttaatattgcataaattatagaaagatgaattgttttttttatgttattaatgtttcttgctccataataataagatattaaatttattacagcttgacctattgcccagcatggtaaggcagcaaaagtatttatctttagtcctattcctgctgctgatgctattgttgttccatatccatttaatatttttgtaattattaaatacgaaatatttaaaatagtcatttgtactgcacaaggtaatccgatttttattatatttatcacgtaatattttttcatatacatatgtttatatcttatttttaataatagtttttttcttaaatatatataagaacaaaagaaagatattccttgtgaaattactgtcgcaaaagctgctccttttacttctaaatttaatttataaataaatatataatctaaaaatatatttactaaggttgaaagtatcacaaaaaataaacaacttaaagaatcttcatatcctttaagaattgaatagactgcattatatccaaaagtaaaaataattccaaaggaaattatttttatataattatttgcataatttaatgcacttaaaggtacattcataaactcaaaaatgttttatgcgataataagatgattatagtaagcataaaagatataattacggaaagtgaaaacaacgtagctatggtatgttttatattttctttattatgttccccgttaaattttgaaatcataacgctggcacctgttgttattcccatgcaaacagaatttattatgaatgaaatcattattgcactactaagtgccgttatagcatttttacccacaatatttcctacaaaagcaatatcaacaactgagtaaagctgttgtaatatattaataaaaataatggtaaagcaagtttaattaatttattatttattttatattcttttttcatgttattctccttatcttgatatataaataaaagacctaagataaaacattatcctaagcctttaaatttgtattaaaataagaatttcataatattaaaacatgaaataggatttttattttaaaaatcttttatttttggcttcgtataatgttttatcaaaacttaatttatacgaagcatagattatgcaaagtttcatttttatctcctttaaggatactaatgattcattatatagtctgccgtatctttatcaattacaagagtattaatatatttaccttttaaagctgcaagaattgcttcgtgtttatcttctcctcctgtaatacatacgacgtttttacttctttttattgcatctatatcaatagacattactctattattaaaatcgcagtctattttattcccgtctttgtcaaaatagtttaagcaaatatttcctactgcgcctttttcttttaattcgttgtagtcttttgggtttaaaaactgttcttttagagaagaggttgaacttgccattaaaccaacactgccaagaattatatcgcagtaattaaataggttgaataatttttttaaactttcttcttgcattaaagtttgttttgtttctttttttgaaacaaatgtaggtgcaaacatatagtatgcttttgcatctattttttctgcaaagttttttgttatgtcatttgttaggcgtgtatctccaagattgttaagacttccaaccaattgaagcgctttaatatttttgtatttaccttttaatgcaggaaaataatttactgtattgtatattgttcttccccatgatatacctattgttaaattatcttcaagtaaatcagttaccagctctactccggctctaccaagcgaatggaatatatcttcgtcttcttgaggctgtgcaaccattactctttttagtgagaacttcttttctatttctgattcaagattaataagatattcttcatatcctttaatgttgatgtcaacaattccaagttctctgctttttttaagaagtctgtttactctttgtctagacatgtgtaatctttgtgcaatttcactttgggttaattcttgtttataatagtaatatgctatctttgtaaggattttttcttcaactgccataaccaacctccataacaaatgttatttttctaaattatatcataatattgagcaaatgtgttaaattatttttaaaaaaagttaaaattggtacaaattatagttgaaatttcaattgtaatgctttacaatgtgtttaaagagaaagtcatttgttacttttgtaaacaaatgctcgtttaagaaaattttttctaacagcattaaaaaataggaggattaaaaatgatgacgtttgaagaaagaaaaaaagacaaaaacgaaatgctaaaagtcttaaaaacaatgcttacttctagacattttgaactaaaagtaaacgaaatgtttatggctggattgattcacggtacaactcaccttggagttggtgaagaagcttgtcatgcaggaattagtttaggtcttaaggaagatgactggattgttcctacacatagaggacacggacattgtcttgctaaaggtgcaactccttataatatgttttgtgaactttttgcaaattatgaaggtggttgtaaaggacttggcggttcaatgcattatattgatttagaacattgtaaccttggaagttctgcaatcgtaggtgcaggtgttccaacagccgtaggtgttgcatttgcacttaaaaaacaaggaaagaaaaattgtgttgccgcattctttggtgacggtgcttcaaatcaaggaatggtgcttgaaggaatgaaccttgcaagtatttgggatgtacctgttttactttgctgtgaaaacaatagatacggaatgtctacaccagcaaaattcacagtaccggttgaagatattgcagttagaggagaaggctttaacataaaatctaaagtagttgacggaatggacgtacttgccgttatggaagctgttatggaagccagtgaatattgcagagaagaatgtaaaccttatctattagaatttaaaacatatagataccttggacattcaaaatcagaccaaagaaaatacagaacaaaagacgaagaagaagatatgaagaaaaatcatgatgctatcgaaagacaaaaaaattatatgatagaacaaggcatgattacacaagaagaatttgaagaattaaataaaaagatagaaaaagaaattgaagatgctgctgaaaaagcaaagaaagtggacaaaatcatctctgttgatgaagcgatgagttatgtttatgctgagtaggaggaaataaaatgggaaaaatatcttatttacaagcaataaaagacgcaatgagcgaagaaatgcgtagagatgaaaatgtgtatttcttaggtgaagatataggtttatatggtggttgcttcggagtaagcagaggaatgtttgatgaatttggaaaagaaagagtaattgatactccaatttccgaaacaggttttacatatgcagcttttggtatggcaatgtttggacttagacctattgtagaaattatgtttggtgactttgtttcattagctgttgaacctatcgtaaacggtgctgccaaatatagatttatgacaggtggtcaagtaaaagctccattggttcttagaactccatttggttctggaacaggtgctgctgcacaacattcacaatgtcttgaagctttattcttaaatacacctggacttaaagttgttatgcctgcaactccttatgatgcaaaaggcttattaaaatcagcaattagagatgataatcctgtatgcttctttgaaaataaacttttatatagaacaaacggtgaagttcctgaagaagaatatactatcgaacttggcaaagctgatattaaaaaagaaggtagcgatataacacttgttgcatggtcaagaactttacttttctgtttggaagcggcagaaaaattagctgaagaaggaataaactgtgaagttgtggatgttagaacactaagaccattagatacagaaacaataattaattctgtttgcaaaacaggaaaagcgttggtagtttacgaagctccaaaattcggaggttttggtggagaaatagtttcaacaataaacgaaagtgaagctttctatcatttggatgctcctgttgaaagacttggtggaatggaaattcctgtaccttacaatccaattatagaaaaacaaattgttccttctgttgatgatattgtagcaaaagtaaaagaaatgatgtaaaggagggtggtaatatgagtaaaatattagcaactcctgctgccagagtttatgcaaaagagaaaaatattgatcttgcaaatgtggttggcagtggcaaatatggtgcaatcgtattaaaagatttggaaaatgttcttcctgttatgagagaaaagggagttaagattaccccggttgcaaagaatgttatgaattattacgatgttgacgttaaagatgtagcttattctaataataaaataacgaaaaatgatgtaatgagtgccgttggtttggaaaaagaagaaaaaacagcattggaaaacgctactgttgttaatgctcctattcttgaagataaagttattccatataaaggaatgagaaaagcaatcggagataacatgatgacatcaatgttaaatgctcctcaagtatctcattttgcagatatagatacaacggaatttatgaatatatttgaaaaaaccaaagctgtatttaaagaaaaatataataaaaaacttaccgttactgatttattaatgaaagctgtttgtatgactttacaaagatgtcctaaagtaaatgcaaactttgacggaaaagaaattcatagaagaagtacagtaaatataggtttggctgttgctcaagaagatgggcttgtagttcctgttttcaatggtgttgaaaacaaaaatatctttgatatttgtgacgaaagaagcgaaattgtacctcaagcaagagcaaataaattaagcggtaaatattatagaggtgcgacttttacaatcagtaatacaggtagaagtgtaaataatttctttacaccaataatcaatcctggtgaagttgcaattcttggggtaggaagaacttctcaaatgcctgctgttgttgacggagaaattgttgtaagaacatttacaggatttagtataacaatagatcatagggtattggacggtatggatgctgttggtttcttaaatactttaaatgaagttttaagcaatcctataggtataataatttaatcaggagaatgttttaatatgggaaaatatatgttaatgccaaaacttgacatgtctatggaagaaggtcaaattctaaaatggatgtgtaaagtaggagataagataaaaagaggcgatatagtcgtagaagttgaaacgggcaaggttgctttggaagttgataatccaacagctgatgggacagttcttgctttatatgttgaagaaggagaggatgtaaaagtaaatactcctataatgtatattggagaagatggcgaagttcctcctacaaaagaagaagccatgggtaaagatgaagaagtaaaagaagaatcaaattcttccggtgatgtttcaatggatgattttgacggtaaatttatgttaatgccaaaacttgatatgtctatggaagaaggagaaattctaaaatggatgtgtaaagtaggggatgatataaaacgaggcgatatagttgtagaagttgaaacgggtaaggttgctttggaagttgataatccaacagctgacggaacagttcttgctttatatgttgaagaaggagataatgtaaaagtaaatgaacctataatgtttataggtaaaaaaggttcaactcctccaacaaaagaacaagctcaaatgcttacaaacccagataaaaaagttgaatcaaaacctaaaaaacaagaaaaagaatatgattatgatttagctgttatcggggcaggtcctggaggatatgtttgtgctataagagctgctcaacttggagcaaaagtagttatatttgaaaaagaaaatataggtggggtatgtttaaataaaggatgtattcctacaaaatcatatgtaaaaaatgcagaagttttaagagaaataaaacatgctgatgaaatgggtattgaaattgattccttcaatgtaaactggtctaaagttttagatagaaaaaataaagttgtatcaaaacttacaggcggtgtaaaaggtttattaaaacgtcataaagttgatgttgttatgggcgaagcagtaatcaatacaaaccatgaaatcttggtaggtaatgattcatacagcgtagataatattgttgtagcttgtggtagtgaatctgttatgattcctattgaaactgataacagtgttgaaattttcgattctgaaaaaatacttaacttagataagttaccaaaagacttggtaattatcggtggtggtgttatcggtgttgaattagccggtgtaatgaatgaatttggtgttaaagtaacaatagttgaaatgcttgacagcattcttgcaatggcagatgatgatgttattaacgtagttgacaaagaacttagaaaccacggtatagatattataacaggaaaaggtgcaaccaagatagaaggcggtaatgtagtattatctgatggtactaaagttaaagctgactgtgtacttatgtctgttggtagaaaacctgttaaagttgcaagtaatgtaaatattgttgtaagtgctaaaggatttattgaaattgacaataaattaaaaacaagtattgacaatatttatgctatcggtgatgttacaggtaaagttatgcttgctcataccgcaagcagacaaggtattgttgttgcagaagatttattcggagaaggtgaagaagttgattacagcatgattccttcttgcgtatttacaatacctgaagttgcttggattggtttaaatgaaaaacaagcaaaagaacttggtattccatataaaacaagcaagatgcctttcgcaggagttggaaaagcacttgcaatgaatgatacaaccggatttgtaaaagttattacagatgaacgctttgatgaaataatcggtgttcatattgtaggacttaatgcttcagatatagttgcacaaggtgcaattgcaatggatcttgaagctacaagtgaagaaattgccaatattacttttgctcatcctactttatcagaaggttttatggaagcatgtgaaggtattaaaggtaaaatgatacatggataagtattaattaaagagcttgataaattcaagctctttttttattgtcttataacaaaattttattcaagttcatataatgtaatgtataatcaggagaatatttatatgataaaattaactaatgtaaaaatagggcagacaaaaaaagtaaaaaaaatatgtgcaaataaagatgataaaagaagatttttagacttaggacttataaacggaacaaaaataaaacctatatttaaaagtcctttaaatgatcctgttgcatatgaaataagaggaagtattatagcccttagaaaagaagacagtgataaaatttatgtatattgattatttgtaaccaaaaacctctttatgcatattctattattaggaagcataaagaggtgattttatggggctaactttaggttcaacaggttctaagttattaaaaaaagatgtatttgaaagagttgtcggatgtgattttaccataggtctttgtggaaatcccaatgttggtaagtctacagtatttaatgctttgacaggtatgcatcaacatacagggaattggactggtaaaacagtaagcaatgctataggagaatataagtataagaataaaagctttcttttggtagatattcccggaacttattctttaatgtcaaattcgaaagaagaagaaatagcgagagattatatttgttttggtaaagctgatttaatggtggttgttgtagatgcaacttgtcttgaaagaaatttaaatttagtttatcaagttatggaaataacaaataatgttattgtatgtgtgaatttacttgatgaagcaaagaaaaaaggaataaatattaatttaaaacttttaagtgagtatcttggtgtgccggttgtaggagtaagtgctaaatataaaaagactttatttgatttaacagaagaaatttatcgtatttgtgtagatgaaataaaaataacaccaagtaatattaaatatgacataaaaatagaaaatgcaatagagcatatatcttctgtcctagagggatatgatttaaaaaatacatatatcaaaaggtggatatcattaaagcttattgaagataataaaaaaattttaaattcaattgaagaatatttggaaattgatttaaaaaataatgctaagcttaaagaagtaattgattatgaaaaaaatagattaaatgaatgtttatcatataattttactgaaatgattatgcaaactatacttaaaaataacgaatttttatgttctaaagtaatccgttttaataacagaaattataacgagcgagaccgaacgatcgataaaattctaacttcaaaattatttggaatacctataatgctgggtttcctttgtttgattttctggattacaatatatggagcaaactatccgtcggaaatactttctaagtttttttcttttataggaattaaactatatgatttgtttaattatatgaatattcctgtattttttaagggcatgttgttagatggtatgtataatacattaacctgggttataagtgtaatgttaccgcctatggcaattttttttccattgtttacgattatggaagaccttggctatcttccaagaattgcatttaatttggatagatgttttaaatgtgtatgtgcatccggcaagcaggctttgacaatgtgtatgggatttggctgtaacgcagccggagttgttggatgtaggattataaattctacaagggagagacttatagctattattacaaatgtatttgttccttgtaatggacgttttccttttttaattacggttgcaacagtatttataggtggtgttggtttaaattttaaaaaatcaatattatgtactttaacggttttacttgttgtattactgggtgtttttatgacttttgttgtttcaaaatttttatcggttacttttttaaaaggagcactttcaactttggctttggaacttccatcttttagaaaaccaaaagtaacaggcataataataaggtccatatttgatagaactttatatgttttatatagggctataatttttgctgcccctgcgggaatagtaatatggcttatggcaaatattacaataggagatattagcattttaggttttgtagcaaattttttagacccatttgcaaagcttatgggactagatggttatattttaacagcttttattcttggtattcccgcaaatgaaatagttcttcctattattttaatgtgttatcttggtaatggaagtattgttgatatagaaagtaccatgcaaataggaaatattttaattcaaaacggctggacaatatttacagcaataaatgttatgatatttatgcttttgcatttcccttgcgccactactttaatgacaataaaagctgaaacaaaaagtataaaatatactgttttatcttttttaattccaacttttttaggggttatgttatgtatgtttacaaatttaatatttaatttgttttttatataataatattatttattttcaattttataatattttaaaactttttttagtacattattgtattcaccactaagaaaagaaaaaacattttgtatatttatattttcttcttttagtggtgaaatttctttgtaaatcaaattataataaatttttatcttctttgataatctttttttatctctctttttattttcaaataataaaagattctcaagtccaattatattgcttaaatattttacaacattaaaacgaataccatttaattttttttcattcatattttttatcttcctttacaaaatttttaatacgaaagtatatataactatttaccataaatatagtaaataaaggtagtaaattattgataaaaaaattaaaatgtggtactatttttgtatataaaagagtttttaatctaattatataattattagataggagatattataatgtgtaaaataaataaaacagaagcaagttgtgttagtgaatatacagttcctgcagatataaaagtaattgaagaaaaagcttttaaagactgtaataacttaaaaaaagttattatttctgaaggtgtaactgttatagggaacagagcatttgataaatgtaaaaatttggaagaagttgtacttccatctactcttaaaataataggaaacaatgcatttaaagaatgttcaagtttaaagaaaataatttttcctgaaggacttgaaaaaataggtaatattgctttttatatgtgtgaatctttggaagaagttgtaattccaagaagtatgaaaagtattggatactacgtattttacggttgctcaggactaagaagcgtaacaattccggatacagtggaaaatattgatttatttgctttccatggatgtacatctcttaaagaaattaacttgcctaatagcttaacaagcattggcggttatgctttttcaaattgtactgggcttaaaacaattaaattacctgaaagcttggaaagcataggtatttgtgcatttgacggatgttcaaatcttgaagaaattttccttccaacaagtctaaaaagcataagcgattatgcatttgatggagcaaacggacttaaaagattatttattccaaaaacagttgaaaaaatcggcgcatatgtttttgcaaactgttcaaatttagaatgtataaatgttgatgaagaaaatgaatattattcaagtgtaaatggtgttttatataataaagatcaaacaacacttttatgttgtcctggtggaaaagatgaagttgatattcaaccaaatgtaactgcaataggaccaagagctttcctaggttgtgtaaatcttgaaagtattgatattttagatggtattacaagtattggaaattctgcttttgacggatgtaagagtttggaacaaatcaatattcctaacagcgttgaaagtattggtgcaggcgcatttagcggttgtagacatattatagatatggttattccagacagcgtaaaagaaattaagagaagcgtatttaacggatgttggagacttgaaagattaacacttccattcattggtgaaagtgaagaaaaaaatacttatcttggatatttatttggggcaagttcttattatgaaaatgaaactgatgttcctgcttctttaaaagaagtaacaataacaagaggtggtattgatgattatgcattcttcttatgttctgatttaaaacaagttaacattaaaaacggtgttacaagaataggcagacttgctttccataaatgcacgggacttaaagatatttatattcctgaaagtgttgaagaaattggcattgaagtattctcaggatgtaaaaatttaacaacacttactgttgatgaagataataagaaatattcaagtgaaagcaatattttatttgataaagaaaaaacaacagtaatttgttgtccatttgtaaaaggtgctgtcgtaattccaagtggagttaagaaaatagaagaaagagcattcagttactgtgatagaatttcaagtttatcacttccaaaaacagttgaagaaataggaagagaagcattctttggatgtagaagtttaattcaacttgcagttccaagcggtgttaaaaatataggtgattatacttttgcaggatttacaggacttaaaagcataacaattcctgaaagtgtaaaaagtattggtgcatatgcatttgatggttgtacaaatcttgaatatattacacttccaagcagtgtcgaacaacttggagtaggtgctttcaataactgtgcaagtcttaaagattttatcattccagaaggtatgaaacatatttcaggttttgctttctatgattgtattagcttacaaacaataagaattcctgatagtgttgaatatttaggtgaaagaacatttgatggatgcagcggacttacatctgcaacaatcggtaaaaatgttcaaaaaatgggaagatatatattcaactattgtaagaacttaaacagtgtaactattgaaggtagcgatactgaaataggagaacacgcatttaaagcttgcgataacctatacatgtttgtaaataaaggttcaaaagctgaagcttatgctaaagaaaatgatattatttgtatagctgaataataaataaatttaaaagacacacttatgtgtgtctttttttgtatataatattttcatatcatttaacggcactgtaaatcatgaagttcatttcttttcttgctataatattatctatcatggaaggaggaaagagtatgaatttgatagatggattacaaaatgcaataaattacatggaagataatataacagaagatattgattatgataaaattgcagaagttgcttgttcttcaaggttttatttttaaagaatatttcaaattatttgtggatatacaataggggaatatataagaaatagaaggttatctttggcagcggaagaactttataataaaaacgtgaaggttatagatgtagccttaaaatacggctataattcctgtgaaatttttagcagagcttttactaaatttcatggaattagtccaagtcaagtaaaaagcggtaattcaaatttaaaatctttttctaaactttccataaaaattgtaatagaaggaggaaaagacatgaattacagaattgaaaaaacaggtgaatttactattattgccaaaagagcaaggtatggagggggtaagaaaataagcaataaaaatataaaaaaaacttggcagacatattttgaagatggcactattaaaaaattatgttcctacattaaacccgatagtatgtttaagggagcaatagtgggagtatgttttgacgatccaacaaagggagattttgattatgcaattgggactttatataatgggggaaaagtaaatgaagaattatctcttgaaaatgttccaaaaaatacttgggcagtatttccttgtgtagggaaaatgccagaggcatttgaagaattgtataaaagaatatatacagaatttttccctacaagtaagtttcaaccttacggaggaatgtgtatagaagtatattatagtgatgatattttaagtgaagattataaatgtgaaatatggatttctgtaaaggaaaaataaaagacctctttagaggtctttatattttttcagtaaacattaattgttctcctgattcttccatttgttcgtctatatgattttccaaatcattaataaagttttcaaaatcaggtagttcagatattttttctattcccgcaagtcttaaaaattctttcgttgttttaaaactcataggttttcctattacgtcttctaatcttccagcttgttcaacaagtcctctgtcgattaataagtctaaagaactgctggatttaacccctcttacaagctcaatatccagtcttgtaacaggttgtttatatgcgactattgcaagtgtttctaaagctgcttgtgagaggtttgtagtattataatttgtaagaacttgttttacataatcaaagtattcacttcgtgttgttagttgatatgtatcatctgttctaactaactttacacctctcatgttataatcatattcgctttgtaatttttttagtaaagatgttgcatatttttcattaatattaagtactttttttattgtatcaatatgcactttatctcctacagcaaataaaatactctcaataatatgtaaaagttcattttcatctttgtttataaactcgttattatttgtttcgctcatctttactcctaaatcttttctaataaaatatctccgtatacttccgattgtgtaagttttacggcattgatttttaacagttctaatgttgcaaggaatgttgcaataatatatccttttttatgattatttttaaataatgatagaaaacttatcttgttttctgtttcaagtattttagatatggttaagatagaatcgtcaacagaaaaagtatctgtttctattgtttgatggtcacttatttcgtttactcttaattgatgttttacaagaatatttctaagagcttttgcaagtagggatatatctatgtcttttacaacatattcatcttttatttcactgaaatattccggatcttttgtaagggacttattgtaaacttgttcgctttcttttaagtttttagtaagctctttaaatgctttatattcaataagtctgtttacaagttcttctcttgggtcgatttcttcatcattttcatctacctcaacaggaagaagcatttttgattttatttccagtaatgtagatgccattacaacaaattcactggcaacttccatatctaaatcgttaaatttatatatataatctaaatattgttttgttatttcaacaattggaatatcatatatatctatttcatttttatgtattaaatgaagtagaaggtccagaggaccttcaaaactacttaaatgtaaaatattttctttcataatactcctttaaagcagtatatttaaaaacggcatcattagaggagataatataattcctattactccggtaataagtaaaactataagtataatatataaatatctttcatactcataaaatttagcttcatacttataaggtagcaagcttgcaagtattttcgaaccatcaagaggtggcacaggaataagattaaatatcattaaagatatatttattattactccgtattgtaagatataatataaagctaaaatatcaaacataggtgcaacaaatttatataaaattgagaaaattatggctagtatcaaattagataaaggtcctgctaaacttacaagtatcattcctaattttctttttttgaaattcattgggttaattggaactggttttgcccatccaaatccaaagaatagtagagcaagaaaccctaaaatatctacatgacttgttgggtccattgtcattcttccagaaatccttgcagtaggatcgcccattttatccgctacaaatgcatgtgcaaattcatgaacactaagtgccaatataattggaataagcatatataacatttgtattaaattttgactactaaataaattcattacatctcctttttagttagtcctcaagccagcttggaactacatcgttttgaattagattttcataagtatctctttttaccattaattctgctttgtcatcttttaaaagtacaacaggaggagttttaagtctgttataatgacttgacattgaatagttatatgctcctgtgtttaatactgcaagaatatctccaggtgctgcttttggaagaaggatatctttaataagagtatctgtttcacagcatttaccacttacagtataaagttcatttgcttctttgttgtatttatttgcaataacagcatggtaaattgcattatatagagccggtcttgggttatcagccataccaccgtcaacacttatatattttcttaaataagggatttcttttattgttcctattgaatataaagttatacctgcaggaccgataatatatctaccaggctcaactataatctttggaatttttattccaagaatatcgcattgttttcttattattttgctgattgtatgtacatattcttcaacatcgaatacagggtcatcgtgtaagtagtttattccaaatccaccaccaagatttaaagcttcaatttcaacacccatttcttttatgttatatacaatttcaagcattgttgttgctgcgatttcaaaaggtttaggtgaagaaatatcagaacctatatgacagtgtacccctgttaagtttaagtattcttcatcgataatcattcttgctgctcttacagccatatttacaggtataccaaattttgaatcgattcttcctgtttgtatatattcatgtgtatgagcttcaaccccaggagaaactctgaaatgtacgttttgaacctttttaagtttctttactattcttccaaccaaacctatttcataaaggctgtcgattgtaataacaccaacacctgcttcaatagcttctttgatttcttctgctgatttattacttccatggaaacagatttttttagggtcaagacctgcttttaaggctgtataaatttctccgcctgaaacagtatcaagacaaattccttgttgttttattattttaaccatagcaatatttgtaaaagcttttccggcataatttatatcataatcaagtccgtattcttcaaaactttctttgattaaattaatggcttctacaattttattttcacttataacgtaaagtggtgttccgaattcttttgcaagcgccacggtatcatgacctgcgaaaataaaatgttcattcatgtctactaactcctaattttaattattttttctttagcttaattacacattatatcagatatttatttctttttaaataaattatattaatttttagttaaatagtatataataatttgtatgaaaaatgataaattaatatatttaagcgaacagatttatttactaatgaataacgatgattataagcctatgaaatttaaagattttgcttatattttttctcttcattcaaagaatcaaaaaaatcttttatctaatgcgctaaatcatctaatcagcgaaaaaatgataaagtatgttgacggaagatattctcttaccaaaaataaagtatatgaaggaatatatgatagaggtaagggtttatttggttttgtcagtgttgatgagcttgatgaggatatatttgtcttaggaagtgattcaatggatgcttttagcggagataaagtaaaagtagaaataataaaagaaaaacaaggagataaaaaaagagaaggaagaattatcgaaataacaagtaaggttaaaagacaaactgtcggtacattctttaaagaaaaaacttttggctttgttgtaagcgataatcctaaatttacaaatgatatatacattccaaaatcaggaataaaatatgcaaaaaataaagataaggtcgttgtagaaataacagatttcccaaaagataaaaattgggttggaagaataaaaaaagtactaggacaccaaggtgatgacggcattgaaatagaatcattaatatatgaatatgatatcccaaatgatttttcaaaagatgcaattaaagaatctaaggagcttacttttgatagtcttgataaatttgaaaataaaagaaaagatataacaaaagaaaatatttttacaatagatggtataacggcaaaagatcttgatgatgcagttagcattaaaaaagacggtaaggattatattttgtcagttcatattgcagacgtaagcaattatgtaaaaagaaacagtgaaattgataaagaagcatatgaaagaggaacaagtgtatatttccctgatagagttattccaatgcttccaaaagctttatgtgaaaatttatgtagtctaaatccaaatgaaaagaaaaaggcttttagtgttgacattaggataaataatcaaggtaaacttatatcatatgaattctataaatcaattattatgtcgaaagcaagatttgtttatgatgaagtaaacgagctttttgaaggaagtaaagaattaaaagaagaatattatatatataaagacgatttgtttttaatgaaagagctttacgaaattttaagacaaagacgctttaaagaaggaaatatagattttgatgttgatgaaaatgaaataattgtaaaagaaggaactgttgagaatgttaaaattagacatcgaggtattgcggaaagaataatagaacagtttatgcttatagcaaatacttcagcttgtgaattcttttcatcaatgggagtaaatggtatatacagagtccatgaacatccggacaaagaaaaaatttccgattttgttcgttttgcaaatgctcttggttataaattgagacttcatgacgaacattataataaagagttacagcagtttttaaaagaaatagaaggggataaaaacgagcagctttttaaaaccgttcttttaagatgtatgaagaaagctgtttatactaccgataataaaggacattttgcccttgcaatacaaaactatacccattttacatctccaataagaagatatcctgacttgatagttcatagagttttatctaatattttacttggtaacattaatttggataaccttgaaaaagaaagagaaaaaatggagaaaaaagcaaatcatctttcaaaagctgaaagaataagcgaagaaatagaaagagaagcagataaaatttttatttgtgaatatatggatagatttatagatgaagagtttaaaggaagaatttccggtttcagtcaaaaaggtatgtatgtaaaattagaaaacggtgtagaaggcgttatatattttaataatttaaaggacgattattatatatatgacgaagaacattattctctaatcggaagagaatttggcaaaaaatatatgatgggtgaagaaattaacattaaagtaattggcgtatctaaattgaaaagagaagtagaattttgtataatataagataaatgtttttaaagagagagtagttatggaagaaaaaatgagaataaacaaatatcttgcaagttgtaatgttgcatccagaagaaaatgcgaagaaattatttcaagcggaaaagttacattaaatggaaaagtggtaaaagaacttgcaacgatggttgatgtgaaaaaagataaagtaaaagtatttggaaagcctgtagaacttgataacagcaaagtatactatatgttaaataaacctgcaggtgtaataagtgccagcaaaagcaaatatggagaagaaacagttgttgatattatagggaaaaaagagcatagattattccctgtgggaagacttgataaggatactacaggtcttattattctaacaaatgacggagattttgcatataagcttactcatccaaaatatgaaaaagaaaagacatatgaagctttggtaaaaggtcatattgattctaaaggattagaaaggcttaaaaaaggtgttgtaatagacggtaaaaaaacatcaaaagcgaaagtaagacttattaaaatggctggtaacaactctttaatagaaataaccataattgaaggaagaaaaagacaagtaaagaaaatgtgtgaaagagtagggcacaaagtactaaaattaaagagaaccatggaaaacggacttgggcttggagatttacaagaaggagaatacagaaagcttactaaaaatgaagtaaataggcttttaagataatatgaatttatttgataatgttacggatataacaaattttataataaacagtaaagttaaaataggagataccgtacttgaccttacaatggggaatggaaacgatactttatatcttgcaaaaaaggtatcacaaaaaggtaaagtatattctttcgacattcaaaatgaagcagtggaaaatacgagtaaacttcttagagaaaataatataaaaaatgcggttctaataaaagataaccataaaaacgtattacattatgttaaggaaaaggttgattttggggtttataatcttgggtatttgccaggttatgataaacatattgttaccaaaagcgaaagcactgttgaaagtttaaaaaatgtcataacacttttaaatataaaaggaattatatgtatatgtgcttatgttggtcatgaaggcggatatgaagaatatttaaaagttaaagaatattgtataaatctacctaaaagaaactttaatgtattacttcttgaacatataaacaggagtgagaatgctcctagaatgataataatagaaaaaataaaatagtggagataatatgaaaaaatatttaataataacttacggatgtcaaatgaatgaaaacgacagtgaaaaaatgagcgggatgcttgataatcttggatatatacaaacagataaagaagaagatgccaatcttattatcatgaatacatgtagtgtaagagaaaatgcaaataaccgcttctttggaaatttgggtaattttaagaagcttaaaaagagaaaaaaagatttgattatcggcgtttgcggatgcatgatgcaggaagaacatattgtaaagaaaataaaagaaaaatattcttttgttgatattgtttttggaacacataatattgcatctcttccttctttacttgaagaatgcgaagcaaaaagaaaacttgttgttgaagtgttaagtgacagtgattctcttcctgaaggacttcctgttcacagacagtttaaacataaagcctttgtaagtataatgaaaggttgtaataacttttgtacttattgtatagttccatatacaagaggaagagaaagaagcagagaatataaaaatattctaagtgaagtaacaaaccttgcaaaagacggagtaaaagaagttactttgcttggtcaaaatgttaattcatatggaaaaaatttggaagatagaatttcatttgccgaacttttaaagagagtaagtgaggttgagggaattgagcgagtaagatttatgacttctcatccaaaagatttaagtgatgaacttattgaagtaataaaaaataatgataagatatgtaatcacattcatcttccaatgcaatcaggttcaagtagaatacttaaattaatgaatagacactatgataaagaaacatatataaatcttgttaagaaaataagaagtgaaattcctgatattgcaattacgacagatattattgttggattcccaactgaaacggaagaagactttaatgatactttagatgtatataaagaatgtgagtttgacactgcttttacttttatttattcaaaaagagaaggtacaaaagcagctgtaatggaaggacaagttgacgaagatgttgtaaaggtaagatttgataaacttgtaaaacttcatgatgaaatattatttaaacaaaatcaaaaatatttaaataaaaccgttgatgtattaattgacggagtaagcagaacaaatgataaggtgcttacaggtagaactgatacatttaaacttgttaactttaccggaaatggtaaagcaggggatatagttaaagtaaaaataacagatgtaaaaacattccatttaagtggagaacaattatagaataggagaaaaattttatggcttcattgacaccaatgatgagacaatatttgcaaacacatgaaacagtaccggatactatacttttttatagactcggtgatttttatgaaatgttttttgatgatgcaaagactgcaagcaaagaacttgatcttgttttgacaggcagagactgtggattagaggaaaaagccccaatgtgcggagttccttatcatagtgcagatacatatattgctaaattggttgaaaaaggttataaagtagctatatgcgaacaagtagaagaccctaaaactgcaaaaggacttgtaaaaagggagattcaaaggattatttcaccgggaacaattacagaaggaaaaatgctaaaggcaagtgaaaataattatattatgtgtatatattataacaagcttgaatttggtgttacatactgtgatataacaacgggagaatttaatgttcttaatttaagcggtgaaaatagagaaaatgagttattatctttactttcaagaataaatcctgctcagataatagtaaatactattttatttgaagatttatctttaaagaagaaaatttcaagtgtaacaaaagttcaacttgaacctcatccattaaattatttcttctttgataaaggaaaagagcttatactaactcagtttaatgtttattctctttcttcaataggtcttgataataatgaaataatagtaagaagtgccggggctcttttaaaatatttggatgaaacccaaaaaagatcattaatgcatataaatgaaataaaaataaacgaagataaaggatatatgcatcttgattacaatacaaaaagaaatcttgaaatagtagaaaatttaagaacaaataataaaaaagatacacttcttgacgttcttgatgaaactattactcctatgggtggaagagaaatgaagaagtggattttggaacctcttcttgataaggatagaattataaatagacaagatgcaataaaacttttttatgatgatgtaatgattcttgaggatattagctcaaatttaaaatatgttaaagacatagaaagaataatatcaagactttctcttgatattgccaatgcaagagatttgatagctttgaaagaatcaataggtgtaataccaagaataagaattcttctttcaaagtttatggaaaaatcaacacttgtaaaagagatatataataacttagatgagcttggagatatttatgatttaataaataattccattgatgatgattgccaagtaagccttaaaaatggtggtttggtaaaacttggatataatgaagaaattgacgaacttaagaatttaaaagaaaattctgcaggaattcttgcaaacattgaaaaagaagaaaaagaaaaaacaggtataaaaaatcttaaaataaaatataataaggtttttggttatttcttagaagttacttcttcttataaagatttagttcctgactattttatacgtaaacagactttggcaaattctgaaagatattttacggaagaattaaaagaaatagaagtaaaattacttagtgttgaagaaaagttaaaagaaaaagagtatgctgtctatgttgatataaaaaacaaggttcttgaaaacataaagagaatacaaaaatctgcaaaaatgattgccgttattgatgttattttatcattaagtgtcgttgcaaagaaaaatagatacataaaaccaacaataacaacagacggaagtataataataaaagaaggaagacatcctgttgtagaaaaaataacaggaatagataatttcattcataacgatacattgcttgataatgaagataatagaatgcttattataacaggtgcaaatatggctggaaaatctacatatataagacaagttgcacttttatctattatggcgcaaatgggttcctttgtacctgcatcgtccgcaagcataagtatcgttgacagagtgtttaccagagtaggagcaagtgacgatcttgcaaacggacaaagtacatttatggttgaaatgagtgaagtatctaatattttaaaatatgctacaaaaaattcacttgtaattcttgatgaagttggaagaggtacctctacatttgatggactaagtattgctcatgctgtaatagaatatttgcttgacaagtcaaaaataggagcaaagacactatttgcaactcactatcatgaattaacggaacttgaaagtgaaaaaagcggtgtaaaaaattattctatcaggcttgaaagtaatggtgatgaaattattttcttaagaaagatagaaagaggcggaattgataaaagttatggtattgaggtagcaaaacttgcaggacttcctgacgaagtaataaaaagaagtatacagatacttgatgttttagaagaaaatgaagaatcctataaaacaaaaatagataatgtaaataagagtttaaataacggaagtgaaaagtttactcagcttgttcttggagctgatgtgaataatgataaattaatggaaggctatgaattaaataaaaaaatagtaaataaaattaagactttacctattgagagtatgagtccaattgaagttatgaattttatttacgaacttaaacaatctttagaaaaagaggaaatttagtcgtggcacaaattataaaacaattatcgaatgagcttgtaaataaaatatcggcaggagaagttgttgtttctcctgcttcggttataaaggaacttgtagaaaattcaatagatgcaggttcaactcatataaaaatagaaatagaaaacggtggaaagtcaaaaattcttgtaagcgacaatggatgtggaataaaagcggatgaattaagtttggcttttagtaaaaatgcaacatctaaaattgataatatagacaaactttcaagtattgatacgttgggatttaggggagaggctttgtttagtatttccgttgtaagcaaagttaaaattaaaactaaatttaaagatgaaaaaattgggacaagggctatgataataaacggaaaagttcaaaatgtatcaagcattgcccttaatacgggaactagaatagaagttgatgatttattttataatacccccgcaagaaaaaaacatatgaaaagtgctaagggagaaaagacatcttctttggatataatttcaaagcttgcaatagcaaatcctaatattgcttttagcgtgtatagtgacggaagggaagtttttgttacaacaggagataatgatataaaaaatgttattacaacaattttaggttatgattttataacaaaaatgatagatgtagactatgaagacgagcctttaattgtaaagggagttacattatcacctaattatttagatagacaaaatgaagaaagtatttttataataaacggcagatatgtaaaaaatgattctttatctaaagcaataaataatatttacagagaacagtttgggctttttacaaaaagaatctcttatgttttatatattaatcttccttataatttcaccgatgtaaatgtgcatccttcaaagactacaatttcttttagaaatgaaagccttattacaatgcttatttgtgagggaataagaaaagcagttagagaatctataaatttaaatgagaattcaaaaataagaaaagagaaaaaagaaaatcctcttgatgctcaaattgcttttgaaaatgcagaagaatatgtagtagatgaaaaagaagtagaaaataaactttacagcataaagaataatgaacaagagaaagaagataataatttaaaaggtgagataaaaaataccatagatattactgagttttacgaacaaagtaaatatccttcttttgttgactttgaagaaaaacctttatttgaagaaaataagaggaaagaagttataagtaaagatacaaatatttctgataaagaaaatattgttgataaaagtatttttgataaaatctcaaatatgaaatttatcggtacagcttttaaagcttatgccatgtttgaaagtggagatactatatttgtaatggatacccatgcaagtcacgaaagagtattatatgatgaatatctaagggaatatcaaaatgaggacgtaagaactcaaattttagctgctccttttgtattagagcttggggttacattaaaagatgtttgtattaataatttggaaagtttgagaaaattaggatatgaaatagaagatttttccggcagtaatgtgataataagagaaattccggaaatgttatctattgaagatacaaaagaaataatattaaatattctatctacacttaaaaatacatcggttttatcaaatgatataaacagaaatgaaagattaattaaatcagcttgtcaccatgccgttagagggcatgatgatatatctgaaagtgaagcaagaaaacttttaaatgatttaaagaaaagtgataatcctttttcttgcccacactcaagaccgacaatttctaaaataaagaaaaaatattttgaaaaaatgtttcaaaggatttagatatgaacaaaattattgttatcgcaggacctacggcttctggaaaaagtgggttatctatagatttagcgaagaatatagatgcagagattatttctgcggattcagtgcaggtgtataaatatatggatataggttcggcaaaagttacaaaagaagaaatgcagggtataagacattatcttgtagatgagttttatcctgatgaaaagtttaatgtatctgtatttgttgaaaaggggatagaatatataaatgaaatcttaaataaaggcaaagatgtaatcattgtcggaggaagcggtctttatgttgatgcgcttatttacgattcttatgaatttaaaaaagaagattctgataatgaatacagaaactatcttgaaaaccttgcaaatgaaaatggaaaagaatatatttataatatgcttttagaagttgatgaagaaagtgcaaaagaaattcatccaaataatttaaaacgtgttataagagctcttgaaatatataaaaatacaggtaagaaaaaatctgaattaaatgtaaaaaagaaaaaatacaggtttgataatacatattatttttgtttaaatgatgatagacaaaaattgtatgatgggattgaccttagagtagataaaatggttaaagagggactcattaaagaagttaaatctttacttgatatgggatatgatgaaaatttaacttccatgagagctttaggatacaaagagattgtaagttatttaaaaaatgaaatatctcttgaagaagctatttatattataaaaagagatacaagacattttgcaaaaagacagcttacatggtttagaagaaatgaagatataatatggatagataaacaagaatataaaaataataaagaaataatagaatttatgaggggttgtataaatgagtgaatttgcaagtgagaaagcaataaaaatagttaaagacgcagaaaagcaggttgaatataagtttaaagaaattgatgaaatatgtgaatataatcaatttaaggttttatcagcaatgcaaaaatataggttagctcttcgtcactttaatgaaagtacaggatatggctatgatgatgaaggaagagaaataaccgaaaaaatatatgccgaagtttttggcggggaagctgcattggtacgacctcaaatagtaagcgggacacatgcaataagtcttatgctttatggtgttttaagaccaggagatactcttttaagcattacaggagacccttatgatacaataaggtctacaattggtataaatgataatggagaagatttaggctctctaaaggattataacgttgattatgataaagttgagcttttagaagatggttcaattgattatgaaaaaataaaagaaaaattaaatgataaagtaaaagcagtatttatacaacgttccagcggatataaagatacaaaagctctttcaattagaaaaattaaagaagcttgtgaatttgttaagggaataaaaaaagatgttattattcttgtagataactgttatggtgaatttttagaaaaacaagaacctttaaacgtaggggcagatatgattgcaggttcacttataaaaaaccctggtggtggacttgtatctgtcggaggatatattgtaggaagtgaaaaaaatataaagaaagttgccgctaggcttacatctccgggaatagctcttgaagtaggtgcaaatcttggagtaattcgttcatatttacaaggactttttattgctagtaaagttacaagcggagcaataaaaggtgcaatacttgctgcaaaagtttttgaaagcatagggtatagagtattccctggagtagatgatgaaagaagcgatataatacaagctgttgttcttggaaacagtgaaaaagtttgtgcatactgtgcaggtatacaaagtgctgctcctgtagattcttatgttactcctgagccttgggatatgcccggatatgatgatcaggttattatggcagcaggaaacttcattgaaggttcttcaattgaacttagtgctgatgcgccaatgaaggagccgtatattgtttatcagcaaggcggacttacatatgaacattcaaaaataggaacaataaaagctttggatgaaattttaaaaattgacgataaaaaataatatgattttttaatcatattatttttttgcaataaccgtataaataaatcctttttcttttttactctctataattgtaaatccgcattttatcatcattttttcaattccttttttgttggttgtcttataatctccgctttttaagaaaggaaaaataaagtgattatcaataaacgcaggaattcctcctactccggtatcagataaaatatatagtcctcctttttttaaaactctgtaagcttctttcattgcttcttcttgatatgggtagtgatggaaactttgtatacatgttactatatggaaaaattcatctttaaaatctagtttattagatgttccaacagaaaaatatgtatttggaatatttttactttttgctactttaatcatattttcagaaatatctatgccaaaataattttgtcctgtttttaaattttcaaataaaaaacctgttccacatcctacatctaatatattatcgtattttaaattatttaaatatgccgatacactattacagcttatttttccttcttttgaataatatattgtgtttttcttatcataatcctttgcttgtttattaaaatgtgttcttgataattcttcaatatctttcaaaacaaaactccttttttatttagaataacataaaaacaagttagcttcaactaacttgttagaatttatttattaactttttattaacttatatgaatttatttaaatataataaatttttataattattttaattaaaagatatttcattttttattttattaagaccatttttttcaagtctggaaacttgtgcttgacttattccgatttcattggcaacttctatttgagtttttcccatatagtatctttttaatattatttctttttctcttccttttaatttgtcaacggcttcttttaaagataaattttctgtccaattttcttctatattttttttgtctcctacttggtcaagaaggtatatactgtccccattatcgttatacattttatcatataaagagcatggttctactatcgaatcaagggcaaagtttagatctttttcctttattccaagactttttgcaatttctttgtttgatatatttttatctttatttagttctttgatttttagtgctttatatgcagtgtcttttaatgaacggcttactctgatacttccgttatctctaaggtatcttctaacctccccgataatcataggaacggcataggtactgaactttacattaaattttgtatcaaaattatctattgctttaataagtcctatacatcctacttggaataaatcatccatattttcattacggtttgaaaaacgctgaacaacacttaaaacaagccttaagttgcatcttataaattcgttttttaaatcttcttcaccattctttattctaagtaacatatcttcaatttctttatttgataaattgggtaatgatgatgtatttataccgcatatttcaacttttcttatcacttggtttctcctttgtatgaaaatttgtatattaaaatttttaccttagataagaaagttattccaatacactaaaaatttataaggaagataatggaatggaattttcttagcttttaattaatttaagtttgtagtataatattaatacttttataaaggagaaaaatatgccaagatttttttgtattgataaggaaaacgatactttttatttagataaagaagatagcaaacatataaaaaaatcccttagaatgatggaaggggatagtataaccatttgtgataagaatgggtatgattatgaatgtatattaaattatgaaggagaaaatgttgttgcaaaaataatatctaaaaaagaaaatgatacggaaccaagcgtaaaaataacattatatcaagcaatgccaaaatcagataaatttgaaatgattgttcaaaaagctgttgaacttggagttagcgaaatagttcctgtaatgacaaatagatgtatttcaagacctgataaaaaatctatgaaaaagaaaattgaaagatataacaaaatttctttatctgcttcaaaacaaagcggcaggggaatagttccattagttaaagaaatgctttcttttaaagaagcaatagagcaaatgaaaaaaagtgatatggcaataatgttttatgaaaatggagggaagaatctaaaggaatttaattataaagatataaaatcaatatcttttattgtgggaagcgaaggaggttttgatgcatctgaagctgaatatgcatctaaaaatgatattattttaatgggacttggaaaaagaattttaagatgtgaaacggctcctatcgctgctctttcagctcttatgttacttacggataatatgtaaaagcctttctataaggctttttttgttgctcgttttattaaaattagtataggcagtacaaatgaaataaagatgaaaaagtatttaaaattactaaaaacaacaataattttatcagttgtttgaggtaacaaagtgattataaaaaatactaacatagaataaaataatcttatattttttatactttttaaattaaatattttctttattccaagtaaggatacaaatgtatatatagaaattttaataagagttgttataaaaaaattaaatccaactactatttccattcttgtaatataatttccaatgcttgaaactcccatggtaatgaaattagggaatggaacttctaaaattaacggaaaacctattaataatacatttgttaaatatgttaaaaaaataattacataacttacggttatgcctataatatatgttttttttgtattttcaaatttgttaatgttatttatctagtaagatttcattcatcttataagtattgttgcttattttttcttctaatattttatttgttccgtcaaaatcttctaagtccattttatatttttcaagcttattttgattaaaagaaaattctttagcaataacacttttttcttccaatattttaattaatttatgaggatcttcttcaccgtaatcattaagaattttgttaatttcaacttcatttaactcaatcatattttgagttctaattaaagatgtatcatatttttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatttagcagaataatctttttcaactttaacatcttttttttctgaaagtctgccttgaagtctttcaatattaccaagcctgtcttttaatatttctatatctgaaataattttattgtaatctttaccttttgtttctttatttacttctttattttcatcatctaaactttttaaagcattattcacatattcttgtttttttcttaaatcgtcaatttgttcttgtaaagatttgttttcactatataaattcaaaaactttgtatataaatcattatttatatctttatatttttttaattcctcaattttttgtcttatcttttcattatcagcttcaacagatttatatttaaaatatgttattttttctttatttcttgcaatatcatttatgtttcttagaatatcttttttcttatttaaaagttcatttaatcttttttcaagtttatttgcttctaaataatattctctgttttcttccattgccttaatggcgtcttctcttgatttttttagttgttcaagtttaatgacactgcttccatattctgatttagattgctttcttgttcctattaaagctttttgtttttctaaataatcaatggctttattaacagaaattttattattatttcctttttcataattcgccaatgcttcgcttatttctcttttaaaatctttttctgttttgttaccaagttgagaaattgagattgtattattatataatacgctgtttaattttataacaggagaaataattctttgttttgtagatgcgtcataaggaagtttatctgttaaatcttcacctgttatattatcaaataacttaaattcttcattttgtttatcaaaatttctttcaatcctatattctcttttaccaatattaaactctaagctgcctttatataaatcactattccatggtttatattttttatattcataagaataaattttatttttactgtaaggcttaaagaaaccgaaaaataccccttgaataaatttatgcgcagttgatttacctgcttcattgttaccatatattacatttaaaccatcttcaaattttatttctttatctttaaatttaccaaaacttttaatgcctaattttcttattttcatctatttggacccctcattcagaagtgcatctagaccaagatacaaagcttcaatatctatttcattttctcttccttttaatgcgtcaatatataaacctataatattatccttattttcggtataaattttaggtaagaaataatctgctgaagtattgtctattatttctgcataatacaattcttcatttaatctggttttaatgtcatctatggttacaagttcacttaatgttccctttaaatttattctatataagaaattatcaatgtttccatttgctttttctttaactaaatttacgatttcttctaaagagtcaattcctgttatatcaacatttaaaacttcaaattgtttaacattgttctttattaattttacagaaacttttttatcctctatttggccaaaaatatatccatgataccctttttctgaaaaatcatgaggttcaaggctaccaggataaacagaattatttgataatttaacagatttatgaatatgtccaagagcgcaataatcaaaacctgatttttctaattttgatttacttacaggtaaataattcccatttggatttagtaagtcacaatgaagtagtaatatattagtttttgttttatcaagtttaggtatttctaaaatatctttattataatatttctttaaaaaacttaacccataaatacaagtatttaagtcttctaattcaactttttccaatttatcactattaaaaatagtaacgttatttgggaaaggaagtaaattataaaaagatttttcatgcataaaatcatgattacccgcaacaataaaaactcttacttctggaatcattttaaatccatctattattctatttacatcacttgctcttacaagttcatcttcaaacaaatcacctgcaatcaagagaatgtcagcttctctttttttgcaggctttaataactttattaaatgctttaaacagatcctctcttctttctcttgcaatgcttttatcaaaagaagatgaaagaaaagaggttccgatatgcaaatctgctgtgtgtataaatttcatattatatagtcctatcattcaaaatttttatcatattccatgctttccaaagcagccaatgcttctttgtacttataatcattctcttcttttaaagattttatcttgttttccttttgtgtttctttttctgttttacttaaaagaatagcttccataagatatgtgtaaagccatgaattatctttatctgaatttattaaatatgctaaatcatttgcaattgtatttatctttgaaatttcgcttattctttcaataagctgaccactgacacgtttgttttgtttttttaccttaattaaattttttacacaagttaaaatatataactcataactatcataaaaatctttatcttgtaaaactcccgtatcaactgcaagatccaatatacttccgtcactgtctaatttttcaagtatatcaacctttgaaaaagtttttccaagttttctttctgattttgtaagcatggcttcttcttgttcaactgcaccaaacctcttacaaatctcattcatatcggaagtatccatattttgttcggaagcttttaaaaatagttcttcattttctttaaaaatttcttcttttattttggcaatactcttacctgattttttatttgataaaattctttttaatctaatataatgaaaatcggcatacaaagcttggtttgcacaaatataataaggtttttgcaaaattcctatatcaatataatgctttatcattcttcctgttatgctgtatccgtcagtttttaatctttggataagctctttcattttcatataatattcgctcataaattctcctcttaaaactatttaaatagtttatctatatcaattttcttacaatgctttatatcaatatttaaaagcacttcgtcgccttctttcactttttcatgaaaaagacttataggcaaaacacctatttgtaaattttcaaattctattacaactttatcattttcaaatctatcaattattccctttatcataatcacttactcgaataaacttcaatacttccgtttttatctataataaatgcaatattaccgtttaaatcggttctatatactttaacaccatgctgttcaagcctatttaatgtttcagttgaaggatgagaatatttattatcttctcccactcctatcattgcatatgtaggttgtatcttttctaaaaattcatcactggtagatttataactgccatgatgagcaacttttaagatatcaactttaccgatcttattcattatttttagttctgcttcttcaaaaatatctcccgtaaataaaacttttcttccgtttgtatttaatacacaaacggcatcggagttatctaaatcatcaagatccatatcttttgtaggagaaataaattttatattatcagtatcacttaattttatctccactccactttttgcttcagcaaaataaagatttttttcttccattttagataccatatttttaaatgaagtagtagtatgagacatttttggcatataaacttttcctacttcaaaattatccaaaacatcacacatccctccaatatgatcagcatgtggatgagtaatgataatataatctatcttttcaatatctctttctttcaaatgggaaaccaaatcttgtgcatgatctgtctcacctgtatctactaagatatttccatattcttcgttacttattaaaaaagcatccccttgtccaacatcaatagcttcaaccaaagtactgccaggttcaatatctgttatataatcatttcccataaagtttgatagatgttcaaatccacccgtaagaaatgatacaaatatcactataagcagcacaactacacttaaaagtttttttatttttgacacttctattaccttgctatatcgtttctgaaataagcaccgtcaaaagtaattttatttacttcgttatatactttttctcttgcttcgtctaaagtttctccaacggcacagatatttagaactcttcctccgtttgtaacaatgtcatcaccgtctttttttgttcctgcatggaaaacaataacatcattacttacattttcaagtccttttataacttttccgttttcataactttcaggatatcctcctgataccataacaacacaaacagaaggattttctgaccatacaatgtcttcttcttccaaaataccatctgcagtatttaacatgatatttgcaaggtcgctttcaagtctaagcataactgcttgtgtttcagggtctccaaaacgtacattaaattcaagaacttttggttctccgttatcaaccattaaaccaataaacaaaacacctttataatcaagttcttctttcttaaatccattaataataggatctaaaatcttagttcttatttttgtgttaagtttatcatcaaaaattttatttggtgaatagttacccattccacctgtatttaaaccttcatcattatcgtatgcaggtttatagtctctggcactttccataggaataattttattcccgtcaacaaagcataaagtagaaagttccgtacctgtcaagaattcttcaataacaacactgtttcctgattcaccgaaaaccttatctatcataatttcttttagtgcattaattgccatttctttattttcgcaaataattacaccttttccagcagcaagaccatctgcttttacaacaaccggatatccgaatttttcaagatttttaacaccctcttcatatgttgttacttctaaatatttagctgtcggtatcttatatttttcaaggaatctctttgttaaacctttgcttccttcaaaagcagcacattgtttgttaggtccaaacacttttagaccttccttttcaaattcatcaacgatacccatgactaatggtagttccggacctacaacagtaagtccaatttcatttgtttttgcaaattctttaagtccttcaatatcatcaacttttatatctacacactcagcaatgctttcaataccggcattgccaggagcacagaacacttctgttacaagaggactctcctttaatttgtaaactaatgcgtgttccctaccaccggaacctactactaatactttcattcttaattctccttttacgaatgtttaaaatgtctcatacctgtaaataccatggcaatgccatattcattacaagcttttattgaatcttcatctcttattgaaccaccgggttgaataattgcagttattcccgcttcatgagccgcttttacacaatcatcaaatgggaagaatgcatcagacgccaaaacagaaccctttacactttctccgccttgttttattgcgttttcaagtgcccaaattctgcttacttgtccagggccgtttgctactaatattttatcttttgctaaagaaatagcatttgattttgtatgttttacggctttccatgcaaatattaaatcttgcatttctttatccgttggttttctgtttgttacaactttaagttcatcactaagaagttttgtatctcttgattgcatcaaaagtccacccattactttcttaatatctttaccatcttgattgaacttaatatctgcaagttccaataatctgatatttttcttctttgttaaaatttcaattgcatcgtcgctgaaacttggagcaacaacaacttcaataaatatattactgatttgtgttgcagtttctttatcaatttcttcgtttgcagcaataattccaccaaagatagattgaggatctgcttcataacattttttaaatgcattagaaatagaagcatcacttgctattccgcaaggattagaatgtttaacggcaactactgttggttcgtcattgtattcttttaagatttccaaagcaccgtttgtatcatttatgttgttatatgaaagttctttaccatgaagttgttttgctaatggaagagaacctttcataggttgtacttctttatagaatacagcatcttgatgagggttttcaccatatcttaaatcctgtgctttatcataacaaagagtaagagtttcaggatatgaatcatctccaactttttctcttaaatagtttgctattaatgtatcataataacttgtagacataaagacttttttagctaaatttaattttgtatcataagaaacttctccattttcttcaagttcctttaatacaacatcataatctttagggtcaataacaaccgcaacgtcttggaaattctttgcagcagctctaagcattgttggtccgccgatatctatattttcaatagcatcttcaaaagtacatccttcttttaaaattgtatttttgaaaggatataaatttacgataatcatatcaattggttgtattgataaatcgaaaagatgctgcatatgttcttcattatctctttttgcaagaagaccagccatgattccaggatgaagagttttaactcttccgtttaaacattcagggaaacctgtaacttcttcaacagaaataacttttacaccttcatcttcaagtgctttttttgtaccgcctgtagatataatttctacacccatttcttctaattttctggcaacttctacaatacctgttttatcagaaacgcttataagtgctctttttatcattatattcctccgtattactctttaatataaactattctgcctctaacttcaagtttatctaagcaaaataaacttacagctttaggtaaaatcatatgttccacttcaagaactcttttttgtaaaatttccggtgtatcatcgtataatacaggaactgttccttgtattatgataggtccggtatcagctccttcatcagcaaaatgaactgttgcgcctgttattttcgcaccatattcaagtactgcttgatgaacttttattccataataaccctttccgcaaaaagaaggtattaaagatggatgtatatttataattctatttttaaactctcttgcaaatgaaggggataatattttcataaatcctgcaagaacaataagatcaatatctctttttacaagctcatcttttatagcatcggaaaaagcctgtcttgaatcataatctttgttgtttataaccattgtttcgatatttgcattttttgctcttgtaagaccgtaagcatcttcttcatctgagattacaacatcaattattccgtcttttttatgaactttgtctataacagcttgaaggttacttcctcctccactgattaaaaccgcaattttttttaaagacataattcaattttctcctcacctttaataacttcaccaagaacaacagcatcttcaccaagagcttttaattcttctaaagttttatcacagtcttcatctcttacaactacaacaaaacctatacccatgttaaatgttgagaacatttcttttttatcaatatttccctctttgcttattaaatcaaatataggaagtacatttactttgtttgtatcaacttttgcacaaagtccatcaggaattacacgtggaatattttctacaaatccaccacctgtaatgtggcacatacctttaatatcaactttttcaagtagtgataaaatacttttaacatatatttttgtaggagtaagaagagtttttcctattgtatcaccaagagattctacataagtatcaacatcataatcctttacttcaaagaataattttctaagaagagaatatccgttactgtgaacaccacttgaaggtagtccaataattttatctccttcttttatatcttttcctgaaataaatttatctttatctacaacacctacgcaaaaacctgcaaggtcataatcatcttctttatacattccaggcatttcagctgtttctccacctacaagtgcacacataccttgtttacaaccttcacttacaccttttacgatagattcaattttctttggataattttttccgcaagcaatataatcaaggaaaaataaaggtcttgcaccatgacataaaatatcatttacacacattgcaacaaggtcgatacctactgtatcatgtatatcttgtttgtgagcaagaataagttttgtaccaacaccatctgttccgcttataagtacaggttttttataaccttcaggaagctcaacagcaccaccaaaacttccaagtccagttaaaacatatttactgaaagtttcttttacatgtttttttattagttcaacactttcgtatccggcttctttatctacaccactgtttttataagttaatttttccactttatttactactccttacctgttcttctctaaaaggcacttccattggataatctccgttaaagcaagccatacaatatcctttatcaaaatcttttacagtttgttttaattcatctattgttaagtaatataatgagtcagctccgataaaatctttaatttcttccaatgataattgagaagatatcaatttttccctattaggagtatcaataccgaagaagcaactgtaagatgttggaggagatgcaactctaaagtgaatttctcttgctcctgcttttcttaatttgtcaacaattctttttgaagttgttcctctaacgatagagtcatctattaaaacaacacttttatctttaacgtttgattttaaaatatttaattttatatcaacaccttcctcacgcatagcttgtgtaggctgaatgaatgttcttccaatatatctgtttttaattaagcccacaccgtaaggaattccagattcttcagcatatccgattgcggcagaaaccccactgtcaggaacagccataacaacatctgcattaatctttcctttatcagctttagcaagtaattttcctgccatagctcttgattcatgaacttcatctccgtcaagaatactatcaggtcttgcaaagtatacaagctcaaaaatacatcttcttggctttgcccaattttctattttataactttcaatgtgtttatcgcttataacaataatttcaccaggttcaacatctcttactaaagttgcccctattgcatcaagagcacaagattcactggcaagagcatatccaccattttcaagtttaccaagacataatggtctaagtccatatggatctcttacaccgattaacatatctcccattgtaagaacaagagcatatgcaccttttacaatttgtcctactctttttaatgcttcaactataccaaatttatagtttcttgctattaaatttgcgataacttctgtatcagaacttgtcataaagattacgccttcatcttgaagcatatttttaattgcatcagcattaacaagatttccattatgagctaaagcaatttgccaatctttacaatttacagtaagaggctgtgcatttttaatatcactatccccagctgttgaatatcttacatgaccaattgcaatgtcacctttttgtttttttaattcttctgatgtaaatacatccccaacaagtcccatacctctatgttgtgttatttcagtatcgttgtttactgctataccacaactttcttgtccacgatgttgtagagcataaagtcctaaatatacataagctgctgtattttcaggagtatcttgcaatactcccattacaccacattcatctttaaatttatctaattgataccccaaagtaaaatctccttatttttttaatttaataaataataaagtattccttattcgcttattctgcctaaaacttctttgtaagtttcttctacatcaccaaggtctcttctgaatctgtctttgtccatttttctgtttgtatctttatcccataatctacatgtatcaggagaaatttcgtcagctaaaacgatttttccgttacatctaccaaactcgattttaaaatcaattaattttaagttgtgttttaagaagaaatcttttagtaattcattaattttaaatgtatattctttaattgtatcaatttcttcttgtgttgcaagtcccattgcaagaacatgataatcattaattaaaggatcatcaaaatcatcgtttttataacagaattcaaatactgtaggatttagttcttttccttcttcaagtcctaaatttttacaaattgaacctgctgcaacatttcttataataacttctacaggtacgatttcaacagcttttacaagttgatgagtatcgtcaagaactttgattaagtgtgtaggaacaccggcttcttcaagcataccaaagattatacctgtaaatttattatttacaatacctttgtttgcaattgtatcttttttcttaccgttaaatgctgttgcatcatctttatattcaataatatattcatctgctttttctgttttaaatactttttttgcttttccttcatataacatttctaatttttccatttttaacaccccttaaattctttcttgtaattttttatctttttcaactacttcttcttccatttttactttgtagtcttcaagttttttatccaagtctttatctttaagcgccatcatttgaatagctaataaagctgcattttcagctccgtcaacagcaactgttgcaacaggaattccttttggcatttgaactatacttagtagtgaatccataccacccattaatgaagttttaattggaattccaattacaggcagagttgtcattgctgccaaaactcctcctaaatgagcagcttttcccgctgccgctattattacttcaaatccgtttgcttttgcatttcttgcaaactcttcagcttgtcttggtgttctgtgagctgaaataactcttgcttcatattcaacaccaaattcttttaacacttttaaacctttttctacaactccaagatcagagtcgcttcccataataactgctacttttcccattagtttctccttttatttgaaatattctacaccacttaagaaaatattttgttccatttctccataaatatttttatataagttgcttccttttctttcactgtgtcccatcttacctaaaattcttccatcaggtgatgtgataccttctattgcacatacacttccgttttggttaactcttggtgaaacagataaattaccgctttcatctgtgtattgtgttgcaacttgtccgttatctataagtttttgtaaaacttcttcattacatacaaatcttccttctccatgagatataggatttacaaatgtatcgcctacattaacatttttaaaccatggagataggtttgatgcaacttttatatatgaaatatttgctatgtgtctgtttattaagttaaatgtaagagttgggcttgtttcatcaagatctcttatttctccgtaaggaacaagacctgttttgattaaagcttggaagccgttacaaataccaagcattaagccgtctctgtttttaagtaaatccataaccgcatcttttattctttcatttttaaatacgcttacgataaacttagcagaaccatcaggttcatcaccggctgagaaaccgccgggtagggcaataatttgagaatttcttattctcttttcaagttcgattacagaatcttctatatcgttttgagttttgtttttaaatacaaatatatcactgtttccgcctgcttcattaaaagcttttgcagtatcatattcgcagtttgttccagggaatacgggaacgataacttttggagaagcaatgcttgtttttcttgttattatacttccttttgtataactgatttcttttacgtctgtttcaattccgctgtcaattgggaatacgctaagcaatggattttcccattcttttataagcatttcaaggtcaagaacttcacctttaactcttatttctttttcgcttattgttttaccaagcaaaacagcattttcgttttctattgtttcgcttgtttcaatgatgatatcaccataatttttagcataaatatcatagtctgaatctaaaaattcaaaaccgattttattaccgaaacacatttttgaaacagcttcacaagcaccgccgacagttattgattttgaagcttttacttttccttgttcaattaattcatgaaccaaatcaaaggcttttcttacgctttcaaactcaggagtgttattttctgttttatttattttaattacatatacattatttcctgccttcttaaattcactgcttacaactttatcggcatttacaataccaacagcaaatgaaacaagtgttggaggaacatctatatcttcaaaagaaccagacatactgtcttttcctccgattgcaggagtattaagttcaagttgtacttttaaagcaccaagaagtgcaataaatggttttgcccatcttgtagggtcttttctaagtctttcaaaatattcttggaatgaaagtcttaattttttataatcagcacctattgcaactgcttttgaaacagaagaaacaactgcataaattgaaccaagatatggattttcacttaataattcagggtcaaatccatttgtcattacagttgctgtttttgtatctcctttttcaagaggtactttcgctaccattccgtcaacttcacttaacatatattttccgccgtaaggcatcaaaacattgtttgccccgatagtattgtcaaaatattcaacaagtcctttttgagaacaaacattgtgatttttaagtatatttataaagttttctttatttgttttatttttatcagctaaggaagatataacatttgaagtttttccaactttaatgcttgcatttttgcttgctccgttagtatcaacaaaacttcttttgatttttaatacttcttcgccgtcttttgtcattacgatattaccgtcatcagttactgttgcaacttgaacggcttcaagattttcttttcttgcagcttctatgaatttttctttatcttcttttgctattacaacggccattctctcttgagattcacttattgcaatttcagtagcatcaagaccttcatattttttaagtacactatcaagattaatatttaagctatcagcaagttcacctactgcaacactcactccgcctgcaccgaagtcgttacattttttaatcatttttgcaacttcatcagttctaaataatctttgaagttttctttcttctataggattacctttttgtacttcacttcctgcagttaatactgatttttcagtatgttcttttgaagaaccactggcacctccgataccgtctctacctgttcttccgccaacaagaacgattatatctccaggatcagatgtaagtctttttacgttttcttcttttgcagcagctataactgcaccaatttccatccttttggctacataatttggatgataatattctttaacttgtcctgtttgaagtccgatttggtttccgtatgaagagaaaccatgacaagcacctgttgtaatctttctttgtgaaagtttaccttttaaagttttatcatatgctacagtagggtctgcactaccggtaactctcattgattgatatacataacttctacctgaaaggggatctcttattgctccaccaagacaagtagctgcaccaccgaatggttctatttctgttgggtggttgtgtgtttcatttttaaacatgataagatatttttcatcttttccgtcaacatctacatcagctcttatactgcaagcatttatctcatcactttcttcaagatcctttaataaacctcttgcttttatttcttttgttcctattactgccatatccataagagtaacaggtttatttttacctacatatattttttctctaagagccatatattcatcatatgtctctttgatttcatcatttattccgccagcttcaatatcaatgtctgttaaatgagtagaaaaagttgtatgacgacaatggtcagaccaatatgtatcaagaactcttatttctgtaagagtaggattccttttttcgtcatttttaaaatattctcttataagttttaggtcgtttatatccattgcaagacccatttcacttaaaagattttcaagatactcatcatcagaatcaataaaaccttcaattataggagtttttttaacttctactttttcatcttccatatcgattttactgtcaacttcgacttctcttgaatcgacaggatttatcaaataatttttaatttttaataattcatcattactgatatcgccataaagaacataaactcttgcatttttaacctttaattgttcattgttcataattaaattagcacattgttctgcagaatctgctctttggtcatattgtcccggaaggtattctataccaaataatgttgcaccgctaaattcaggcaatttatcaacataaatattatcaacgttaacttcacttaaaacattgttaactaaattttcaaaatgttcttcgccatcaactaaaatatcatatctattaaatatgtttactttagttaaagaagaaatatttaagttgatttttaaatcacttaataaatttgcacctgaggtatcaaacccatcctttttacctataaatactctttttatcatctcttactccaaatcatgtaataatattattaaaaaagttaaacttttatgtattaattaataataacatatttttatatattttaattagtatttttatatatttttatataaaaagttaaaaaattttgttatatattcctaatatataatacctataatatataaaaatgcaaataataaaaacacaaaaaactctcctttaaggagagctttttgttatacaccctgcttatttagtctaataagttctgtaggtgtaaagttatgttttggggtgtatccctcgattggcattatattttcatgaaaggcgtcaataatccaatcgctttgagggaagaaagtatgatcaagttcatgcgcaggagtaatccagttttttgctcccacaacaacagcaggtccgtcaagataatcaaaagcaagtcttgtaatattacttgccatatcttgaagatatgaacctctttcacatgcatctgatgcaagaataattttgcctgttttcttaacagattctattactttttcatagttaaacggaacaagacttcttgcatctattacttctgcacttattccatattcttcaagtttatcagcagctcctaatgctgtatataatgtaggaccgattgtaagtattgtaacatcgtttccttttctctttatgcttggttcaccaaattctatttcataatagccttctggaacactttcttcaaattcttcacctttgtcatacattttttgactttcaacaaatataacaggatctgttcctctaagtgctgaattcataagaccttttgcatcataaggagtatttggataaacaacttttagtcctggaatatgtgtgcaaagtccgctccagtcctgagaatgttgtgccccatatttatttccaacaggaagtctaagtattacaggaatcttaagtactccggcactcattgcatgccattttgccatttgattaaatacttcatctccacatctaccgataaaatcagcatacataagttctgcaataactcttccccctgccatagcataacctacggctgttccaactatggcagcttcagaaataggagaattgaataatctgtgatatggaagagcttctgttaatcctctatatactgcaaaagcacctccccagtcacgacattcttcgccgtaggcaataagtgtagagtcatttttataaccttcaactatcgcttcaaacaaaccatcccttatttgaaaaactttgtttttagatacttttttaccatcttcatcataagcacttcttacttttctttctattgcttttattcttggattatcttcaagattaatttcaggaactctgctttcatctctgtttactatcttttcattagaaaacataatattttccataagttcaggatgattatcaagatccattcttggtgatatttcagggtctattgaaagtttgacagcttttttaatatcttctcttactgcaagttctatttcctttaaatcttccttagtgcatacaccagcttctaccatttgatttccaaaatcaacgattgaatcttgttcttcccatgcagcaatttcttcttttgttctatatgtagaagagtctgatggagagtgacctgagaatctataagtaacaacttcaagaagtaccggaccttctccgctttcaactatttttctctttcttctatatgcatctataacagcaagaggattataaccgtcaaccctttcagcatgcatttggttaggagtaaccccagcccctaatcttgcaaccataccataagccattgtttcacctttagtttgaccacccataccataactattattaaatacattataaataataggaagtccgccgttaaatccatcttcccaaagctctctaaattgatccatacttgcgaagttcattgattcatatacaggaccgcatccaattgcaccatctccacagtttgcaattactataccttttttctgatttgctcttttatataatgcagcacctgtagctataggagcagagccccctacaatggcattattaggataaagaccaaaaggtaagaaataagcatgcattgaaccaccaagaccttttgaaaagcctgtttcttttgcaaatatttcagctaaaaatccatataaataaaattctcttgctatatcttttacatcagttgaagttgtattttcttttattattttatagatttttccaccatcaaattcttccattattttagttaattcttcatcgcttaatttttctatggcagataaacctttcgccaaaacttcaccatgagaacgatgagaaccgaaagaataatcgtcaatggttaaatcaaatgcttgacctacataagctgcttcctgaccaattgcaagatgagcaggacctggattattatattccattccttcatattcgcttcttgtttttattaagttaagcattgtttcaaattctctaatataccacatatctctgtaaattcttttaaattcatcagtagagaattcatcaagtacatctttaacctttttttgataatcattaacttttatatcttcgaattttatcgtgcctttttttctaacttcgtttgggtcaacatataaacttttagtcattttactttctccttatatactaaatattgcctctcttattatttcgccaacacttggatgagggaatactaccttttttatttcctctatattcatattactttcaaccattgttgcagctgccaagataatttcacttgagtaatttcccatcatgtgaacacctattaaggtattccattttttatctacaattatttttattattccgcttccgccttcattttcagctacatatcttccagaatactgcataggaagttgttttactataaaatcaatacccttttcttcagcactttgctcactttctcccacacttgcaatttcaggattggtataaattacacttggcacagcattatatttcattctgtctttcttacctaaaatattattaactgcaacttccgcctctctgtatgctgtatgagctaacataacgccacctacacagtctccaactgcatatacgtttgctatatttgtctgttgtttttcatctacttttatacagcctctttcggtatatacattcaaattttcaagacctattccgttaatatttgctcttcttcctattgataacaatactttgtctgcttcaactttattttcttcaccattcttttcaaagtaaacaaatttatcatcaactttagttacttttgattctaaatagaatttaacaccttttttctcatattctttctttaaactttcagatattgttatatctgtaggaccggcaattttacccatcatttcaactactgtaacttcacaacctatagagttaaaataacttgccatttcaagaccgataactccgcctcctataacaactaatttctttggagcttcttttagtgaaagaatttctttatttgttaaaacaaatccgcttccaagtccttcttttactccaggaataggaggttttacactatcagatcctgtcgcaataatcaaatatgtactttcttttatctcaccgtttacttctacttgaattttaccgtcttttttttctttgatttgagcatcacccataataacttctactttttttgattttaatgccatagaaacaccaccaacaagagttttaacaaccttattttttctatctattacagcactatgatcaattgttatatcctttgcacttatgccgtatttatcaccgtgtaatgctccatcataaagttttgcagaatataataatgtttttgtaggtatacagccttcgtttaaacatactccaccaatatgctctttttcaataagtaaagtctttttaccttcggctgatattctttcagcagcaagatatccgcctgggcctgcacctataacgattacatcatacataaaaatttacctcctatttagcaagcaaagcagagaaattttcaagcgcttcgcataaatcctttaataatcttgctgcatcagcaccatctactgctctatggtcacatgtaagtgataagttcattgctttatatggaacaatatttccatctacaacttttattttatcaacaagaccacaaacacctaagatacctgtttgaggtggatttactattggagtaaaactttctattcccatagaacccaaattacttacggtaaatgtagcaccgctcaataaatcagggcttatcttaccttcacttgccatagaaccaagttcttttgatctttttgatatttcatttaaagacatcttgtttgcattaaatattgtaggaactaaaagtcctctctttgtatcaacagccatacctaaatgaacattgttaaatactctcaatttttcatcatcataatgagcattaaagctcttgtgatttaaaataattcttgatactgcgtacattattatgtcgtttacggtaatcttttcaagtcccaaactttccattgatgattttatagtctttctataattcatcatgtttgtagtatcaaagctacgattaaatgtaagttgagccatattgcttaaagatgcatgcattgattttgcaataacttttcttacatttgaatgaggaatatcttcatattcatttattgtatcgtttacattttcattaataaaaatagaactttcttcttgttgaatttcattattgattttatatccatttttagccaaagttaaaatatctctttctattacccttccgtttggacctgtggcaacagctttgtctaaatctaaatgtttttcttctgcaagcattcttgctcttggagaaactttgttttcaccagaaactgaagataaagtaacttgtgttttttctacttcaactttcttttcttctacgtcgttttttacttcttcttttacttcgtttccttctttagataaaaattcacttatgtcttcaccttcactgccaatcacacaaacaatatcaagacaaggtacatcgtcaccttcttctgccaaaatcttcaaaattgttccgcttacattggcttcttcttcaaaagcagatttatctgtttcatattcaaataaaacatcaccctcctttacgctgtctccttcttttacgttccaattagtaataatacaactttctaccgattgcccttgtctaggcattattacgcccgttgccataattacctccttaaaatattatgttaaatttttataaagttatctaaaatataatcagcaatcctttcagagctttttccgtctttatatttaaaatgtgtatcaataaatttatcatattcgctaaaatcaaaattaccttctttgataatatctattacctgatcagttttatatgctctttttcctattacttcttttttaaaatcttgataaaatccaggattatcattatattcatcaagatcatatacatatagtataagaggctttctcaaaacagaatattcaattatcgcagaagaataatcagtaataaaaatatcacaaaccggcattattttatttaaaatatcctctttatcaagattaatcaaaaattcactatcttcagtttcttctgattttgcacttaaatgtggtttatacaaaagaacatatcccaaatctttaagctcttcttccatttttttcatatttaaatgtagttcagtttctgcatcacttcctctacctctaaatgtaggagcataaagaataatttttttatctttaagcttaggatatttttcataaaattctctttttactcttgataatatttcttcatcaaaaaacaagtctgttcttgcacttccaagaaccaaaattttatcttcatccatcccaaaagcagttgcataatgctcttttgaaaaatcacttcccataatacagtaatcgtaatttttatgtctaaatttatcttcaacactttccccttcgtttactgcatcattaccgaatttcttaagtgcacctgctgcatgccaaacttgtattacagttgttttctttttatgctttattatatgaacaggaaaatatgcattatccactattaatactcttgatgtagctaaatggtaaatatctcgtacaagtcttaataaataaaatatttttcctacaaacgaatagctgtattgttcaaatagaaaaacgtattttaaatcttttctttttttgtataaagctctatatatatatttaatattgccatccaaaacagtatttcttggtgaagcaaatgtaatttttcgtttatttaccggtattaggtaaaatatataataaaataaatgcaaaaatatatttgataaaatgtattctgtataattcataaaaaatcctttcaaactagttatattcacattatactttacaaagtttcttttgtcaaagattttaaagataaaaagtaaaaataacttttttttatttttcttacgaaagcaaatgtaacacatgttaattttagttaataaaaatttaattttcagacaaattaataatcactatacttttttttatagttatgatacaataatttaccgtaaaatataagaaaaagaggtacgatgtatgttttatattgatatgataatatctaaattgattatcctgcttattaatattattgataaaactagaggaacagaccttcccggtaaaatagctttaaagcttaataaaaattttcctttgggatttaagaatattgactacaataaagtaatatttgtaaccggaacaaacggaaaatctacaactacaaacttaatacaccatgtcttaaaatcaaacaattacagcgttgcatcaaatcttgaaggtgcaaatctaattgccggaataacaacaacattaatcaaaaactctactttaaccgggaaattaaagcctgaatattttgtttttgaaatagatgaaagatcattaaaaaacattcacagagttattcctgcaaaacatcttgttataacaaatcttcaaaaagaccaagtacacagaaatgctgaccctgactttatttacagaaaaataaaagatgttgtaacaaaagatatgcatttatatttaaacaatgaagaaccaagaagtaaatcatttgaagactttgcggatgatataacatattacagcgtagaaagaaacgaaagatctgtagttgataatgacagacttgcagttacaatgccttgtccaaaatgcaaccacaaaatcaactttaattattacaatgttgacaatgtaggtaactttaattgtacaaactgtggttttaaaagcgaagataatccagtttaccaaatgaaagatgttgattttgaaaatgcaacttttacttatgatggaacaacatttaaaatgccatataacgttcctttcatgatgtataattatgctcttgttatagcacttgcagacaaacttggacttacaaaagaacaaatgcaacattcatttaatacttttattaacattggcggaagaatagaaacaattaagtataaagataaggaacttaaatatataagaatcaaacaagaaaaccctgaaacattacaatctgccatagatgtagtggctaatgataaaacagaaaaaacatttatacttggactttgtataataaaagacgagccacctcactatacaaacacattctatgcatatgactgtaatttcacacctcttgtaaattcaaatataaagaaatatatcgcattctctgaatatgtatgttatgacactgcaaacagatttatctatgaaggtgttgaaaaagataaaatagatatattaaatacagatgatgtagaaaaaatacttgaaaaagtagatgaagctgaatgtaaaaatgtttatttaataacatggcttgaaacatttatagatattaaaaattatgttaagaaaaacaatttataggagaaaaaaatgggaaaagaaattaatttagcttacctttatgccgatatattaaaccttcatggagacagaggaaatgttcttgcttttgagaaaatagcaaaagaaatgggtatagaattaaaaactacaagaattgacagcccaaacgaaaaaattgactttgacaaattcgatattatacttttatctccgggagaattaaaagtaatggacacaatagtagaaacttttaataatcaaagagacgaatttgagaaatacgtaaacgaaaataaatatatgtttgtaattggcacaacaggtgcaatacttgcaaaaaacattaaatttgaagacggaagagaaaaagaaggcttaaatgtatttgatatgaaagcaacagaaagaaaatggatatatggtgatgatttaacatttaatgctaatatagatggtaaagatatggaaataatatcatgccaaattaattcaattgacatgacttttaatactgatgaaattactcctttcggaagtgtaaactacggacttggaaatgacaaaaaccataaagaaggagcaagaaaaaataatttaatttatacaaatgcattaggacctgtttttattaaaaatccatggttaacaaaagaaatattactagatatagcaaataaaaaagatattgaaattaaaaatatcgatttagatttttctattgaagaagcttcaaaagaaacaataaaagactttataagtaaaaaagaacctgtacaataaaaaagaaccattaaggttctttttttatatgtaaaaaagccgctaaaagcggctttcctaccaaaaagaaaaaatggtaaacatatataattattaaaataattatttacgatatttttcgtcaagcttcattacttcatcaacgttgctttgactcttacaaccttgttcaaagtcattgtctaaccagtgttttaaaacaacttttgctgtttctttgccaataactctgtatcccatagtgataatttgtgcattgttgcttaagcttgctctttctgctgaatatgggtcatgacaaacagttgcacatactccaggaactttattggcagcaatactcattccaatacctgttccgcagaataataaacctctgtcataatcttcatctcttacggctaatgcaactttttctgctatatgagcataaaaagttttatcattttcatatttaactcctaaatcagttacttcgtatccttcgtcttgtaaaaatttaacaatttcatcctttaaaagtaaacctactgcatctgcacctaatactatttttttcatattcttcctcctattcgtaatcaaaacctgtacatttattcattactttaacgattgtttcatatgatggagcatcgttgtataaaatttcatataatgcttccaagaaaggaagtttttctctttttaatactcctttttcttcaagttgagctacaagttcccaagcaaattttatcgcattataaccttcaactgttatatcttcatctctcattttctttatggcttttgttcccggcatcccagcacctacaacttcacctaaaattctgtttcttcctgcttcacatgtaatttcaagatctccaacacccggttgacctataacagaagcataacttccgcccattgcttttgttaaaacgcccatttcagcaactgcaaatgtgaataaagctgctttacagttattattgtttttaccttcaagttctttaaaaccttcagccattccaagaccgattgaataagcatttttcattgccgcacaaatttcaagtccgattacatcagttgtaacacctacattatatttatctgttgcaagaagactcctcatatattttgctgcttcaatatccttacttgcataatctactgagtttggacattcccatacaacttctacagctttacatggtccgccaacaaataccaaaggaatttttccttttaattcttcaggaagtaattgttctaaaatatcaggaagaataattactttgtctttttgttcaagatcgtattcaaaaccttttgaaacactacctacaaccattccttcttttaaataaggaattgcttttttaaacacgcttgcaagaccatcacttgttatacccattataactaaatctgcgccttccatagcttgttcaagttcttcattgtaaaaatacttaattccgtctgcaagtttacatttgtgttttatatgagttccgtcttttttcaactgatcgataatttcagtatcaagatgagtcccccataagtttacattgtgtccgttctttctaagtggagtagaaagggcacttcccatcgcccctgcaccaagaattgttacattagccatattatatgtacctctctttattttaattactatattttatataaaaaaaccataacataataacacatgtaacatgtgcatttcgttatggtttctctaattctcttccaaaactttctattaagttatatttattatatacgataagtgaaaatttttcaatatattttaattatatttaatgatttttttctctaagaatgaaactaaaaaatacataattcctgcaatagccgataaaataaccactcctgccataacaagatcaagattaaatacctgtgagccatagacaattaagtacccaagaccctctttacttacaagaaattctcccattataacgcctacccatgaaagacctacgtttatttttaaagcatttattatattttctatacttgaaggaaaaactgcttttgaaaaaatttgcatctttgttgcattaaaagtcttaagcagtattatcttttcttcctcgacttgcataaatccggaatatacacctattattgttgcaacaattgaaattgcaagagtcataattaaaatagaacccattcctgctccggcccatacgattattaccggacctaatgctactttaggtaaagcatttaacacaaccaaataaggatcaagtatctttgcaagcctatcactccaccataatatcattgctattatcgttccaagaattgtacctatgctaaaacccattacagtttcaaacgttgtaataaagaggtgattataaagcccgtttgtttttattaaatccactattgttttaaaaattctacttggagaagatgtaataaattgattaatccatcccatttttgcacttagttcccaaatcaaaacaaaacatactaaaatcgcaactttccaaaacaaaactataaaattttctttttttatattttttaagaaattttcatgttcttttttctttaaattatcatatatgcacatctaaatccctccatattttatcataataatcagcaaattcctttgctttacgcctttcaactggacttaaagaatcaacggaaagattaatttcatatatattttttatatttgccggtctttgagaaataacaaccaccctgtcagccaaagaaatcgcctctgataaatcatgggtgacaagaattgcggttttattgcttctccttatagccaaacttatatcttcacttacggcaagtcttgtttgataatctaaagctgaaaaaggttcatcaagcaaaagtatatcgggttttagagcaagagttcttattaaagcaactctttgcctcattcctcctgatagttgttttggataagcatttatgaaattttctaaaccatacatttttaaaagttccattacatattttttatctttatcatcaatttttcctcttgattttatttcaagaccaagtaatgcgttatttaatatggtacgaaaaggaaaaagctcatcttgttgcagcatataacctattgtagggtcttgtttacttatggtaaaagtaccgctgcttggtttaattaaatttgaaagcatagataaaatagtactttttccacaaccgctgggacctaccaaagctataaattcaccttcatatacatccagagaaaacccttctactgcagttattatgctgtttttcgtatgaaagtttttcaccaaatctctaatttccaataaaggttttctcattgctcatactcctttatctattttgttttctctgcaaatgtagtatttactaaatctttatatgctgctttttcatcaagctgtcctgccatagtcataatttcttgaagtctgttaaaagcatcttctgttataacaggtgtatcattccatgcatcaatacttttatatctgtcaattactttaactaaagtatccttatctgtatcaggaaaaaactctgctatgttatctgcaatttcttcactgcttgcactatttacatattttaaacctttagaaacagcatttgtaaaactttgaataagatcgggattttcctctataaaaccttttcttgcattatatactgtataaggaacttcaccgctttcttcacctattgacttaagaacatatccttgtttattttcttcaacctctgttgcactaggttcaaataatgctacataatcacctgttccacctacaaaagttcccgccatagctgcaaattgtacagatgtatctaatgtaacatcttttttaatatctaaaccgttctttttaagtacatattcaagagtcatttcaggaacaccgccggctcttcctgcaataatatgttttcctattaaatcagagtatttaaaattccctttactatcttctctaccaactaaaaatgatccatctttttttgttacttgggcaaagtttattaaataatcttcttgacctccctgcataacataaatagttgcttcaggaccgcaaaatccaatatcactatctccgcttaaaactgcagcagttactttatccgctccttgtgccgttgtaagttctatatttattccttcttcttcaaaatatccaagactaatcgccgcatattgaggtgcataaaagattgaacgtgcaacctcgctgacttttacggttgtaagtccttcatctttattgcttccacatccaacaaaacaagacagacaaactaacacactaactaaaagtccaataatctttttcaaattactacctcccaaattgttattcaccattatagtatgctgatttatttaattttgtacttatataaaaagtcttttattgaaaaacaaaaattttaatagtaatatattagatacaaatattaattatgaaattaaagcaatcaataacttaatatggcaaagaggtaataaatgggaacaatagtaaatgttattgcaattttatttggaagtaccataggaatgctttttaaaaaatttataaataaaagaatagagaataatttaaaaaccgctctgggactttctactgtaataataggcatacttggaataatcacttctagtattacagtagataataacggagtactacaatcaaataatgtattattacttgttttaagtttggtaataggaacttttatcggtgaaatcttaaatatagactataagacaaatcagataataaaaaaattagaaaataaactttcaatacaaggattttcagatggatttattcctgcttcggttttattctgcacaggggcaatggcaataataggatctttaaatgacggacttataggagatcatacaattctcttcactaaatcaatacttgacggaacaatagcaatattattcgcttcaactttaggatttggagtatatttttcaagtttaaccgttttaatttatcaaggagcaataacaattcttggaatatatttatctccttatttgtctgatgcacttataaataacatatgtctggttggatatgcaatgattgtatgtatcggtcttgacttaatgaaaataaaagaaataaaagttttaaatatgcttccgggacttttaatccctattttatatgctttaattttttaaaaacaaaaaagaagagtacaaactcttctttttattttaaaattttttttataagattttcttttttctttgtataaggctgatatcttagattaatatcaattaaattgcttcttttaagtatacttttttcatgagaaaaagtattaaacccatattccccgtggtaacttcccataccactgttacctactcctccaaaccccatatattcatttgtaagatgaacaatagtatcatttatacatccacccccaaaattaactcttgataaaatataatcttctaaagctttattatcagaaaacaaatataaagctaatggagttttgttatggtttattatttctacaatatcttcttttgttttaaacgtcattataggaataataggcccaaatatttcttccttcatacaagcgctctcaaatgttacattatctattattgcaggctcaattcttaaattcgctctgtcaactttccctccccaaattatatcttcattttttaacatagatacaattctgttaaaatgcttttcatttattatttttacataatctttatttttaagaggcttttctccgtattgaattgatatttccttttttaacaattctataaaattatcttttatattttcttttacaattaaataatcaggagcaacacaagtttgtcctgcatttaaaaatttaccaaatactattctttttgctgcaagtttcaaatttgtattttcatcaacaatacaagggcttttccctccaagttccaacgttacgggtgttaaattcttacttgccttttccataaccagtttcccaacgcttacactacctgtaaaaaatatataatcatattttaaatcaagtaaaaagctatttacttctcttcctcctaaagcaacacttactaattctttaggcaaatatttttcaagaagcttttttaatacttcacctgtatattttgaataagcacttggctttacaacacaaacatttcccgcacttattgcatctactaaaggagagatcgtaagcataaaaggataattccaaggactcataataagaactaaaccataaggaacctttaccttgtaacttttactgtaaaactgtgatatcggcgttttaactttctttattttactaaatttctttatatgttttatcatatagtttatttcagttaaaaccattccaatttcacacatatagctttcataataacttttacctaaatctttttttatagcttcacaaatttcttcttccatttcaagaatacctttttttaaattttttaaaagttctattctaaaattaatatctaaggtcttgccgctattaaaaaatttattttgaatttttattttttctcttatttccatattatcaccactattttatacaaaaaaatatacttaaatacataagtatatttttataatttaatattaattatcgctatttttattagcattattctttttttcttgttcttcttttttaagctgctttgcttctttttttcttctaagtctttctctttctttttcctctctttgttgtcttttatttattttcttaattcttttttcttcttttttattttgatactcttcaatttgttcttttgtaacactcatgttttttgatttaagtttttcttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcccacaacaaaataagtgcaaagcattattaatgtccagaaaaaatctgctcttaacaaaggtacaaatggaccaaaaaacaaagttgtaaaactaaatcctaattttgatttttttattctattttcattattttttagaaatattttcattctacattacgcctccgttttgacataaacatatattagcacaaaatttgtaaaatttttatataatttgttgtttttaatataattataagattccggcaggttcattttggttgaagatttggttttgaaaaatcttttaaacgctcctcttcttttttcctttgaaaataaacatatggttgttattgaagaattttatataaaaaacttttttacctcttttgatattgcagatgagaataatttcaggaataacatttatgtaatctcatttgatgaatttatttactctataatacataaaaaaataattttatatgatattttaaggtcaaataaaggtttgaattatataactatattaagtaaattaaataatgttgttgttttgtttttgtcaaagccttttttaaaaaatgaaatattattttatgatgtaattaagatggaaataacaaaaaaatataagagcgaagatatatttttaaataatattttttgtggaaataaaatatattttaaggctacaaacaactacgataatgaaataatttatgatgagaagataaataaaattttttcatggcaaaagaatgatttattaagttcctttatgtttatgggctttcttgaagataggtatattatatttaaaaaagaaaatatatatgaaaaagagaacgtatataacatttttgatacaaaaaacaaattaagcaaaaccttttcttcaaagcttgttatagtaaatgatgaattattgctttaatgggaaaaataaatttatttttaattcataatatgataaactataagaaatggggtaattcgtatgtcaaaagaatttgttgttgaaacatatttattttgtgaaaattgtttggaagatacgatgcacagagctctttataaagatggggaaatagttaaactaacatgtcttcaatgcgataatgaaatcatgttaaacagacctgccccaagaataaagaaagaacgtggcttttcaaaattttttacaaaatttcttgtgttcaaatcataaaaattaaattagaagaggtagaaaaatgcgtataggatttggatatgatgtccataaacttggtaaaaacaaggatcttattttagcgggcgaaaaaatagactattctgaagggcttatagggcactctgatgcggatgttttagttcatgctttaatggatgcacttcttggagctttggctcttggtgatataggaaagcatttcccggatacggatgataaatacaaaggcataagcagtatgcttttacttaaagacgtatgcaggatgatagataaaaatggatataagcttgtcaatgctgatatgactcttgttatgcaagcaccaaaaatcgctccgtatatacctaaaatgcgagaaaatatttcttttattatgaatactcctatagaaaatataagtataaaagcaaccacggaagaaaaacttggtttcagcggaagaaaagagggaatcaaagcttactgtgtatgcttgcttgaggagaaagaatagatgaaattatttaatactttatcaggtaagaaagaagaatttgtacctatacatgaaaatgaagtaaatatgtacgtttgcggtcctactgtttataatttctttcatataggaaacgcaagaccttttattatatttgatactttaagaagataccttgaatatattggatataaggttaattacgtacaaaactttacggatatagacgataaaataataaacaaggcaaaagaagaacattctacggcaaaagccgtatctgataaatacattgaagaatactttaaggatgcaaaaggacttggaataaaaaaagcaactgttcatccaagagtaagtgaatgtatagatgatattatagctttaattaaagatcttgaaaaaaatggttttgcttataacgtagatggcaatgtttattacagagtaagtaaatttaaagattacggaaagttatcaaaaaaacctatagatgaacttatgtcgggatcaagagttgatataagtgatgaaaaagaatcacctcttgatttcgcattatggaaaaaacaaaaagaagaaagtgaaattgcttttgattctccatggggtaaaggtagaccgggatggcatatagaatgttctgcaatgagtagaaaatatcttggagatactattgatatacatgggggcggggaggatttaatattccctcatcatgaaaatgaaattgctcaatcagaaggagcaaacggtaaagagttcgttcactatttcgttcataacggatatattaatataaataatgaaaagatgtcaaaatcaaagggtaacttctttatggtaagagatatcgcaaaggattttgatcttgaagttgtaagactttttatgttatcggctcattataaaacacctgtaaacttctcgtttgatatattaaaacaaacagaaagcggattaaaaagattatataatactaaagaaaatttagaatatatgcttaaaaatgctaaatcagaagagttaaaggaagatgaaaaagaatttgtttcttctcttcctaaatatagacaagaatttaaagatgctatggaagatgatataaatactgcaaatgcggtaagtacaatatatgaactaagcaaagatatcaattcaaatataaacgaaaattcatctaaagaaatgattaaagctgcatatgatatgtatatggaattaaacacagttttaggtcttcttcaaaaagaaaaagaagaagaaattttagaagatgaaattttagcattaatcgaacaaagacaacaagcaagaaaagataaagattttgctttagcagataaaataagagatgatcttttaaaaagaggaattgttcttaaagatacaagagaaggtgtaaagtgggagaaagtaaaatagataaaaaagacattcttgccataggaagcaaagagcttgcgtatcttggggacagtgtttacgaagtaaatataagaaaaagactaataaggcttggtataagaggcgtaaaggatcttaacaaaatgagtatgaattacgtatcggctttgtatcaagccgatattttttcttacctaaaagaatttttaacacaagaagagttaaaagttgcaaaaagaggaagaaatactaagataaaacacgcatcaaaaagcgtaaatattgcaacatatcgtttggcgacagctcttgaatgtgtgtttggatatttatatatgctttctgatatagaaagaatagatttccttatggacaaggtgtttgaatataaacttaaagaggtagaataatgagttataccgttttatacagagaattcagacctaaaaattttgaagaaataatcggtcaggataatataataaacattcttaagaatcagataaaaaatgattctatttctcatgcctatctttttagtggaataagaggaacaggtaaaacatctaccgcaaaagtttttgcaaaaagcatatgttgtcttaacaataaagacggagaagcctgcaatgaatgtgcatcatgtaaagatataaatatgggggacagtgccgatattatagaaattgatgccgcttcaaacagaggtatagacgaaataagagaccttaaggaaaaggtaagctatatgccaaacttcggaagatataaagtttatattatagatgaagttcatatgcttactcaggaagcttttaatgctttacttaaaacattagaagaaccaccaagtcatatagtatttatatttgcaacaacagaaccaaataaaattttacctacaattctttcaagatgtcaacgctttgatttttctagaatagacagtgatgttgttgtaggacacttggctgatattcttgataaaaaaggaattgagtatgaaaaagaagcgctttctttaatagccttaaacactgaaggtgctatgagagatgctttaagtttacttgataaagctatttcggttctaacggacaataaggtcacaaaagaaatcgttgatgacatattggggcttataagcgatgaagaagtatataatcttgcaaacggcattttagaaggggacgtggaaaagagtatcacttccgtacatgaatatatggaaaaaggcagagaagtaggaagtataataactcagcttatggaatattattcaaataaaataatagccatgaacgtaaaaaatcctgaaaaaataataaataaaagtaagccttatatagattctttattagaaaagtttaactcaaaagaagacagtaagaggataagcgatattttatattctctttcaaaattaaaaaatgatatgagatttttctctgaaccggaatttttatttacggcaaagataatcaatttatgtgaaggtgatggtgaaagttttgtttctatagaaaaaggtaattctcaaaatattaatagtatgcctgacagcgaagaaattgaacttttaaacgatagaatagaatctttggaaagagaaataaaaaaattatatgctcttaaagaagatgttgaaaatataaaaaatatggatttttccggtgtaagtgttcctaaaaaagaagttatacatttaaaagaaaaaccaaagaaagtttcacctgaaaaagatgaatatattgttgataaaaaagagattgcttgggcagagaaagttttgtctcttactcagcgttatattataaacagcaataaagaccctcttgtaggtatgagtgtaaataaatttaaggtagttgaagtaggatttaattctattacaatatatcccgataaagctttaaatatgatggatttcttctttgataacgatggagataaaatattcaaagaagctctaagtcttaaagccgggaaaaaattagatgtaacttatattgacaaaaagataaaattaagatataaaaatgatagcagtaaaaacagcttaaaaagtcttaaaaaagatttgaatatgaaaaaagattttaagactgattttaaagcggaaataaaagaagatgcaaaagaagacatcaaagaagaagcaaaaattaatacagaagaagtttataaagaacaaaaagaggaaattatagacacttctttgaataatgacaacaatgcgtctttagaaagtacaatgcctgattatgacattaatgaaattatttcaggcgaagatgaggaatttgtttccgatgaagaactagctgctatagataatgaaatagtattggatgatgacgatattatggatttaggagaagattatgacgcatcaatcatggaaatattcggtgcgaaagaagaataacggaggtataaaattatggcaaaaggaagaatgaacggtttcggcggtggcgcaggaatgtcaggaatgatgaaacaaatgcaaaaaatgcaagctgatatgcaaaaaatgcaaaaggaacttgaagaatcaacttatgaggcaacaagtggcggcggagctgttaaagcagttgtaacaggagaaaaacttgttgaatctatcgaaattgatccagatatgttaaaagaagaagatgctgatatcatatgtgatatggttgttgctgcagtaaacgaagcaattaacaaagcaaatgaagatgcaaataataaaatgggttctattgcgggaggacttggcggattaaatattccgggactataaaatgagcgtttattcaaaacctatattaaatttaataaatgaactttcaaaacttccgggagtaggaagaaaaacggcaagcagacttgcttattatatagttaatatggataaagctgatgttgacagtttatccgatgcaataaaagccgcaaaaaaagaacttaaattttgttctgtttgttacaatataacagacaaggatccttgtgatatatgcacaagttcaaaaagagacagatctacaatacttgtggtaagtgaatcgaaagatttaattgccatagaaaaaacaaaagaatacaaaggtctttatcatgttcttggtggagttatttctccaatggaaggaataatggttgaagatataagaattaaagaacttataagcagaatcggaacaagtgatgaagttaaggaagttattttggcaactggttttaatgttgaaggagagacaactgcaatggttataaagaaattgttaaaaccttttgatgatataaaagtaacaagaattgcaaaaggacttcctcaaggtgcagatcttgaatatactgacggtgcaactttggcaaacgcaattattggaagaaatgaaatttaaaaaagtacaaccaggttgtactttttttattttgtttattttttatttaataaaataagcaaaagttcttttttatcttcaatgctccagcttttatagtcttgaaaagctaccatttgagaatctttaagcatattttttaatgttaaatttagatagttttcatcgtttaaaagactttcgtccaaagaagaaaattcttgtttttccttcttttcttctcctcttaaaagataatcggtacttacattaaaagtatcgcttattttttttatcattgttgatggaatatttctgtttcctttttcatacatacttattgtatttggatgaattccaagtttttcagccatatctttttgagtaagcttattttctttccttaatttttttaatctatctccaattgtttccatttttatttctccaagactatttattaattaaagaatatcacattatgttaactttttcaataaaaattcacaatttacagtgaaaatatcaataaaaacacacattttgtttactttttcttgacaatcacacgtattgtgtgataatctattcttgtagaaaaaatgttcgatttagatattgtgcgttttaggaggtaggatatgaaaagcgaattatacaaacaaacagaaagaagattatatgattatccttttttggtaaagagaattgagatgattaaaaaacgtcttgaagagctcgagatgaattctttgaaaggatatcatacttacttattatccgatgagcaaagccgttttgaagattttattgcagcggaagcatctaatatttccgattttagaatacttcttcaacaagagttaaaagaaaaagaaaacatagtttttgaaattgaaaaagcgctggaatgtttaacggaacttgagcgtcaaattgttataatgagatattttaaaatgttgagaatgtcggaaataagtgatgaacttggatactccagagagtatagcagtagagtaagaaaaagagctgtaaataaaatcggtatggttctttggggtgttacaagtgaggaaatggaaaaaaagagaaaagaaataaaaaattttccaatttaaacaagaatagagatattcttgttttttattgacaaattctttcttgtttaatataatagaaaaaattgtttactttgtgaactaatttaggagttaatatggaaaaaatcagtgaagagttcttagatgcatggctgaagctatcagttatacttagaaataaaagatatatgattaatttatcatttaatgaaggtataatatgtcatcttctttacaaagaatcattaacaggcagtgaaaaaggtgttgcacttaaagatatctgctcaaaaactcatattttaaaatctcaggtaaataaacttataaaacagcttgaaggtaaaaacataataagaagaaataaaagtctaaaagataaaagattggttttagtaagtttaagtgaatacggagaaaaagtatataaaaatgagtatgctagaatcattaagcttgtaaatgaacttgtaaagaaaatcggagaagaaaaagcaaaatcggcaacggatatttttgaattaatagcaaataatgtagaaatatttaacgggagggaaacatgtcagtaaaaatattaacggattcatcttctgattatgaagcttatgaaattaaagaaaaaaatatagaggttgttccaattgcagtatcatttggagaagaacattatcttgacggagttgatttggataaagatactttctataaaaaattggaaagctcttctgaatttcctaaaacagcacagccaacccctaatgaatttttagaatattttaacaaagcaaaagaaaacaacgatgaccttgttgtaatacttctctcaagcggactaagcggaaccgttcaaagtgcaaacattgcaaaagatatgtgtgaatatgataatatttttataatagacagcgtacatgcggttacgggagtaagaatgcttgttgacagtgcaataaaacttagagatgaaggtaaaagcggaaaagaaatatataatgaaatattagttttaacaacaaaagttcgttctgttgttatggtagatacacttgaatatcttcataaaggcggaagactcacaaaagctcaagcgactttaggagaagctgtaaatatgaaacctattataagtatagacgagcttggtaaattatatatgaaagataaatcactgggcaaaacaagagcgtacaaaaaaattattaaattatttaaaagttttgatattgatacgagctatcctgtatatttcccatattcaaatgaaaaatcaaactgtgaagagcttgtaaagaaattaaaagcaatggatattgatgtggatgaaaaatatatgtataatattggaccaactgtaggcgctcatcttggaagcggaacttttggttttacaatggttgtaaaataaaaacgaattccttttgtaattcgtttttatttatttcttattaacattatgaaagaaagtatcaaattcaaaataattcccgccattatgccaaaaacaatttcctcgtttttttctccttgtgcaagttttaatattctgcaaataagtactgataaaaagggaattaaaatatatattatattaaagtattttttcatatgtatcacctaaatataaatttaatatatattataaactaaaaaacgaccgtttcggtcgctttatcttaactcatatgtaagaagtgcattttcgctttccgtaaagtttgttaaaaatactgtatcatattcttttataaattcttcatatgctttttgtgcttttgataagctgtcataaagagcaaatacacttggtcctgagccgctcatttgcacccctattgcatcaagttttttgaatttgtcttttatatattttatttcaggatatttttctaaaacaaaaggttcaaatacattaattaatcccttttcaagttttttcttgtctgcttctaaaagtcctgtcattaaagctgtaaaatctggtcttataagatccgttgcattgtctataaggtcatatgcaaattttgtacttactccaaaatcaggtttgcataaaactacatagcaaggaatatatggataaatcggtctgattttttctccgattccttcacacatgcctgcgccgctatggattaagaaaggaatatctgcacctattttttcacctattgaacaaagctcatctcttgaaagattaagttcatagattttgttatatgcaattagtgcagctgctccgtttgcacttcctccgccaagtcccgcacaaactggaattttcttttctatatgaacagacagtaattcattttctttatttagtttgcttatttcttttatgcatttataaactatattactttcatcctttggtacttcggtattattgcatgtaataacaatcttatcggatttttcaaaggttaaataatcataaatatttatggaatgcattacggttttgatattgtgataattatcttctctctttcctacaatatcaagccctaaatttaccttagccggtatttttatttgtagtttattcatcttataccttcggtttataacattttaggaacgtttatacatctttcgtctttacttggagcattttgtaatgcttcttctattgttaatccctcttttacttcatcttctcttactacattttcaagatttaaaacatgggctaaaggttttattccatctgtatctatattatcaagtgcttttgcataatcaagctgtttttcaagtgtatctgtatatttttctgcttcttcttcgcttatttttaattttgcaagtgaagcagtatataatacatcatcttttgttactttcataataatctcctcgtaaacataatttaactattaatttattttactttttttgtaaacaatagtcaagaaacaatactcattaatgtaatatattaatgatcttctaataattttttattattattttaataacttgtgctataataggaataattaaatataataggaggatagcgcgtgaaggtaatattacttgaagatataaaaggtatcggaaaaagaagagaaattaaaaacgtaaaaacaggttatgcaaataactttttatttaaacaaggcaaagctgttgaagcgacaaaagccaatatagaaaaaatggaagaagaaataagacttgaaaaagaaaatcatgcaaaaaatgttgctgaagcaaaagaaaagaaagaacaacttgaaaaaattaaagttgatttaaaagctaaatcaggtcctgacggtaaactttatggttctgttacttcaatggatgtaagtgatgcaatagaaaaagcaagcggactaaaaatcgacaaaagaaaagttgttatggataacataaaaaaccaaggtgaatacgaagttaaagttaaattatttgagaatgttgttgcaagtgtaaaaattaatgttgtaagtgaataatattaatataagtaattaatacaaggagcgaaaattggcagataaattaagtttaaaggtcatgccgcacagcagtgaaacagaaagatgtgttcttggttgtatgcttatagacagtgaaactataaacattgtaaaagaagtcttgagtgaagacgacttttacgacggagaacataagtgggtctataaagccattgtttctcttgctgatagaggaaaagcggtagacacattgactctttcaaatgaattgaaagaaaataatgtatttgacaaaataggcggatatgagtttttaacaaaaataggagacagtgttatatccacaaatcatgttgatgattattgtacaattattaaagaaaagtcaataagaagaaggcttataagagagcttggaagtgttattgatcagtgctatggagattctatagaatcttttgatataatagaagctgctcaaagagccgtttataacatatctatggataatagtacaacggactttacgtctctttcatcagctgtaagtgatgctgttaacgaactaaacagaatacaaaagctggatgaaaaagtaattggggtaccttccggatttgattccattgatgatataacatcgggttttcaaaaaggagacatgattcttatagcagcaagaccgagtatgggtaagacggcacttgcggtaaacattgctcaaaatgccgctataagatataaaaaatcagttgccattttttctcttgaaatgccaacaagacaacttgcaaacagaattatgtcgggagaagctgaagtagattcttcaagacttagaatagccaatatttttccgagtgaatggtcaaatttatatgataccgtaagggaaataagagagaaaaaagtaaaattatttataaatgatacttcgggtatttccgtaggggaacttagaagaaaatgtagaaaattaaaagcaacagaaggtcttgatttaataattatcgactatttgcagcttatgacaataaatgaaagaagcgaaagcagacaacaagaaatttcaaccatttcaagaacattaaaatcaatcgcaaaagaacttgattgtcctatcattgcattaagtcagctttctcgtggtcctgaagcaaggacgaataaaagaccaatgctttcggatttaagagaatctggagccatagaacaggatgccgaccttgtaatgcttctttacagagataaatattataatcctgaaagcgaagatgattccacagaagtaattattgcaaaacatagaaatggtagtgttggtaaggtaaaacttaaatttagaggtgaatacactaaatttattacaatagaagatgaccctacaagctcagaggcttatagtgatgagaatttaggataggagatgaattttaaaatgagagatatttttgaaaaagattttattgttaaggtattgatacctttggcggtaacaatgcttgtttcgggagttttatttattttaggaaatgcatttattcttttggttgctgttattatttttgcaggacttttcttctttacaaaatataataaagatttggttgaagaagagatatattatgaagaagaagatacttctccaataagagaattaagagaagaattaaatctttcaaaagattatacaaatgattcaaaagcaaatagctacgattatttaaaagataatatgattaatgaagataatctatcttttcttgatatagaagatgaagaaggcgaagcccttcattttgaaaaagcagatatgtctttaacacagcaaattaaagcaagtgttgatgaggattatccggaaccaactcttaaaaaacctgtaagaaaaagtaaagcagtttctgctccaaagaaaaaagcaggtaatgttatttcaaaatcaattaaaagtgtgaaaaacagaaaagaagttccaataaaaaaagaaattaattacgatgatgattttgaatttgaatatggttcttatgatgaataattaaaatttattcttacttaaaataaaaaaatatgataaaatatattaaaacgcgtggtcataaaatggcgtaaatccagtttatgactgcgcgttatttttttggaggtaaatatggaaagacgtaaaatagaatttgtaagaggaattataatgtgttttataatggtatttggcatgaatttatttgaaacagttctgcatttaggcgcattaaatattaatgtttttattgagagttttaatacatttatttttgtatttatagcggcgtatattattcaaaatttagtggtaggaaaggcaaaagattatattataaaaacatttttgaaagaagaaaaaagcagtcttgcttttatgttgtttaatgcggtatttatagttacgttcatgtcaatgataatgacagtaataggaggtataataggaggggaaagcttcgctgatgttttaaataattactttaatgtatggccgagaaatttttgtatggcatttttcttaaacatatttgttgcttctcccgtatgtaactatttatcggggaaattaaggaatttgaataacttaaatgccgaaaatgcggaatagacataaaaccgacttaaaaagtcggttttatttttatcttacttaatcttgtaaagcatcttttccagtttcttttgttctgattctttttacgtttcttatttcgtagctgaagatttttccgtctccgacttctccggtaaaggcggattcttcaatggcttttattgttttggcttcccattcttcggaagaaaccacgatttcaaatttaatttttggtctcatcattatgtcaacttttgttcctcttacatattcgctaaatcctttttgagctccgcagcccattacctgggaaacggtaattccgtttacgcctattttatttaaagcgtctttaacgtcttccagtttttcttctcttacaattgcttctatcttgattatcataatatatcctccttaatccaatccgttaaatgacgggtatgcactttctccgtgttgtgttacgtccaaacctatcttttcttctttttgggttacacgaagcggagtgaagattccaacgatttttgcacagatgaatgttcctatagctgcaattagtattgatacgactatacctattaattgagccgcaaacaattttatgtctccaaaaaccaatccgttccattgagctacggaattgatagaagtcattgcaaacaatccggttgcaataccaccccatataccgcctattccatggcatccgaatgcatccaatgcatcatcgatttttaattttccttttaagaatgaaacgccaaagtagcatattgggctgacgagcagacctattataatcgctgcccaaatcggaacatatccggctcccggagttattccgacaagacctaccacaagacccgttgaagctccgactaatgtaggttttccgtttttcaaagtttcaataagagcccaagaaacaagagccgctgccgatgaaaccgccgttgtcataaatgcgtgtgccgcaagtccgtctgccgcaagagcacttcctgcgttaaatccgaaccaaccgaaccataacaatcctgcacccaaaaatacaaacggtgtattgtgacctttgaatccttgctcaaatccttttctttttccgagcattaacgcaagtacaagtccgcttactcctgaacttatatgtacgacattccctcccgcgaaatcaacggaaccgattgacgccaaaaatccgttttctccccataccatatgggccaaaggataataaactatcaaagaccaaagaattataaaaggtaccaatgctttgaatttcatccttcctgcgaccgaacccgtaatcaatgccggtgtaattacggcaaacatcatttgaaatgccgcatatgccaaatttggaatggtgtcggaataataatcgggttccattcctactcccgaaaatccaaaccatttgcttcctccgataattcctccgtgatctcctccgaatgacaaagcatatccgaataatacccacataacgattgcgatacccatgattatgccacatgccatcattgtgttaccgacattttttcttcttacaagacctccgtagaaaaatgccaagcccggtgtcataagaaaaaccaatgcggcacaaatcaaaataaaaccagtgtttccagtattcattttattacccccgttttttataatttaataaaaaacaaaaaaggcacttagaaattaatttctaagcgcctttgctttttatttttaatatttatggattatatcagttaattatttaaatgtcaaccaaaaaataataatttatttgataaatataaaagtttatgtattttatgcttttaaaattatctttatcatttcactcaccgcattttcgttattggttttgttaagtaaaaatttggctgccttttttgcgtcttcggatgcatttttgactgcaaaagaatattttgtgttttttaaaagttctatatcgcttccttgatcacctatcgtggcaatttcgtcttttgttacgttataatgtttcataagttctttaagccctgtaaatttatttacttttgtcggtcttatatcatatacgtttctgtcaacggttccgtacatgctctttggcagataactttttaaatgttcaaggtccttttcattttcaaaacgtacggaaattctgtaacaatcttttaacgtgcttaaatctcccttttttaagctttcttcttttatccaagttatcacatcttgatataaaggtccttttttgttgtaaaagtaaccgtctttgttaagaggcataaagtctcggttttcttcgttgaatttttttaccaaaaatgaatatacgtggttgtctatcgtaacaagttcttttataccatttttgtaatctattaatatggctccgtttacgcctatatgtacactttcaaataaatcaagttcttttactatgtctatcatggattcttcgtttcttccggatattatgcttgctttaattcctttttctttgcataattgtattgcatttttatcttcttttgatatggttccgtcatctctcagtaaggttttatccagatctaaaataagcaactttatcattttattcaccctttacgatgtttataagctcaagaggtgtctttatatggtaattggcattgcaagtttctttttcttcttcactgccatagccataatctgccataacggcatcagtgccattttttttgcctcctattatatcggtaggtttatctcctatcattagaacctttttaggatctttaatgtttaatttatccatggcttctttaaccaaatccgatttttctcctcttgtctgcattgtatcctgtgcaattacttctttaaaaaatttttctatttcaaaatattttatttgaagttttacattttctattggtttatttgaggctattgccatttgtactcccatgttatcaagagtttgtagcatttcataaactccatcatacaacgttgcttcaaaacatccatgttcttgtacgtattttctatgtatcataatggcttttttgccttcttcttggtcaaatccgtacttttcaattattagttttgcaaaaggaggtccaatcattttttttacgttttctattgtttccgttattccatatgctccaagtgcctttacaaatccttttgctattccaagccatgagtctactattactccgtcaaaatcaaatattacagtgttatatttcataattattcctcttttctttatatattattttataatagcaaagtatttttttcaattatatttagatggttatcgttatttatgaagtggaattaaatatttatggtcttataagaatgtaaattaaatatatgttatttagcgataatggcttcttctgatattagatttctcttttttgttaattttatgaaataatagaaatagaaagtagattagtaataggtttagcaatatgcttaaggttttgtttattgcctcttttctttgtaaaacaatattttcttctgtcatatcttctgttttatttatattttttattttgtttaaatgagttaaaactttgtttccgtatcctttgccgggataagcccatccttttttgtaaggattatcagagtatccaaggtattccacatatatggcttttcctctaagggagtcgttccatctcgggtcaacacatttcccatttaaaggtttggttgaagcatagcactttaaatgctgaattacggctcttattcctatttccattgttttaaaacttgcaccttttactcctcctcccgtggttccaagccctgcaaaattattttgttccttttttacatctcctgtaaaatttaaatatcctgtttcatgcatcattaatgcaaatgctatatctgctcttacaccttctttttttgcttctttaatggttgttttgacgaagtcttgtgcatactttttagtaatgggattattgccttttttatcgttgttttttattagatatgtatacatttgatttgcgctacactcgcagttttcacccattattttagtgagttttttttcattctttccatttactaaaggcataaaaagtggtaatattaataaagttatcaaggtgaataaaataattatgtgaaatttattaaaattttgtgaataattcattaaaagcctctttttttacattttttatattattattattataaattaaaaaaaataatttttttgtaatttttaataatgataaataattaaattataaatataatttgtttaatgaaagggtactaaattgagaaaaacattaacaaaaatcattggtatttttataattggtattattttggcgggagcaactttatttgtttctgtttcccttagcttacctgatatttcgggatatacttattctcctaaacttaaaactcaaattttaacagaggataatcagttggttggtgaagtttatgatgaaaacagaacccttgtttccattgatgatatgcctgatgatcttgttaatgcagttgttgccgttgaagatagaagattttatcaacatcacggatttgatattaaaggtatattaagagccattgtggttaatctaaaaggagacggtattcacgaaggtgcttcaacactaacacagcaggttgtaagaagattattcttatctgatgagagaacttatacaagaaagataaaagaaattttacttgcagtaaaatttgaacaggaatttacaaaagaagaaattttggaaatttatcttaacgatgtatttatggggcaaggaacatatggtgttgaagaagcttcaaagagattttttggtaagcatgtacaggatttaactttagaagaatgtgctttgcttgcaggtattccacaggctcctaccgtttacaatccaactacagattcaggttatgaacaatccaaaataagaaaagaagaagttttggatgcaatggtagaaagcggatatataactgaagaagaatgtgaagaagcaaaagcagtaaagatttctataaaagaaggagattctgaaaaaggatttaatggaagaacaagagaaggctgtggtgcttattctcaacaagttttggatgaagctcaagatgtattggtaaaaagttttactgaaaaagaccaaatgagtgaagatgctgcaaaagcaaaagttgaacagatgattaatcaggacgggcttaagatttattgcagtatgaatatgagtttacaaacttcaggtataaaaagtgtaaaagaatttatgtctgcatatggtcttactgatagagcggatatggcttttgttactgtagatggttctaatggaaaggttcttgcatattatggaggtgcatcatctattgatatggcaaatactcctcgtcagccgggaagtaccataaaacctctatatgtatccaaatatttagaactccctgataaatctatatatactaccgttcaagacggtccgattaatctttatgggtattcacctaaaaatgcgggtaacagatattatggaagggttacaattaaacaggctattacaaattcattaaatacagcatgtttaagactttttgaagaactgggaactgatgaaaacggcaatttagaaggatataatgctgtaaaagactttggatttacaactcttgtagatgttgaggataatgctgtttataatgataataactatgcatttgcccttggaggtcttacttatggcttaaaacctttggaacttgccagtgcatattcgacatttgcaaatgacggagaaaaatatccttattatttcgttgaaaagataacaacaaaagacggtgacgttctttatgaaagagaagaagcaaaagcagaacgcataagaacaagtgaagcaaatgaaggaatagttgaatgtatgaaaggtgttgtaacatcaggtacaggtacattggctcagactcaatatgaaacatttggtaaaacaggaactacaaatgacgataaagatttctggttctgtggcgtaaccggtaatttagcaacaagtatatgggttggaactcctgaaaatgatgtaatatatggtatttcttcatcaggagttgcatctttctattcaagatatgtaaataatacagatgaaatagatgattttggtaagattgcaaatgtaagtgaaaattcttcttcagatacagaagaagaagtaaattacactagtttattggttgtaaaagataatattgatgtaacggatagagaatactttacaagacttgaagttgaaaccatatctattccggaagatgaggtggataaatatcaaaatagagtagttactcaagttacggtagacagcgacagcggacttttatttaatgaagaaaagtgcgataatgcaaacaaagaaatcaggtattatataaaaggaaacgagccaacaaagaaatgtaataaacttcatatattttagaaggtaaaatatgatagatgcaaaaaaagaaatagaacaattaacagaagaattattggaacataacagaaaatattatgaggaagataatccaagtatttctgattatgaatatgatatgcttcttagaaagcttatgaagcttgaagaagaatatcctgagtacaaaaaagaatattcccctaccgacagggtagggggaaaggctcttgatgggtttgaaaaagtaaagcatgagtataagcagcttagcttggctaatgctttttcttttgacgaacttttagagtttgataatagagttaaaaaagaaatagaaaatcctgtatatacattggaaaataagtttgacggactaactatagttcttacttatgaaaatggtatattaaaaacaggagcaacaagaggagacggtgaagttggtgaagatgttactttaaatgttaaaaccataaaaacaattcctcttaaattaaacaaagatgttaatttgaccgtaaggggcgaagttttaatatataaagataactttgaaaagattaataagcaaagagaaaaagacggagaaagtctttttgcaaatcctagaaatatggcagcaggttcaataagacagcttgattcaaaagttgcggcaaagagggatttggattgttttatatttaatttagagcatatagacgaggtggaactttcttctcatagtgaaagtcttgattatttaaaaactcttggatttaaagtaagtgaatataaaaagtttagtaatataaatgaaatatttaaggctttaaatgaaaaagaagaggagagaaaaaaactaccttatgaaatagatggagctgtaataaaacttgataatttaagagatagagaagttttaggttctacaaataaaaatccaaggtgggcaattgcttataaatttagtgaaacaaaggtaaaaaccttactaaaggatattattgtaaatgtaggaagaaccggaacattgacccctgttgcaattttagaaggtgtaaatatagatgggtcttttgtaagtcgtgcaactcttcacaatgaagattatataaaagacaatgacataagaataggggataaagttatagtaaaaaaagccggagaaataattcctcaggttgtaagttccgtaaaagaagaaagaaatggtgaagaaataatctttgaaatgccaaagacttgtcctgtatgtggtcatgaagttgtaagggaagaaggcataagcgcaataaaatgcgtaaatatagactgtccggctaaaatttccagagaaataattcattttgcttcaagggatgcgatgaatattgatactttgggagagagagttttggaaaacttaattgaagcggacttaattcaagatgtaagcgatatttacagattaaaagataaaaaagaacaaatagaacaaatggaaaaaatgggtgaaaaatccgttttaaacatgattgaagcaatagaaaaatcaaaagaaaattctcttgaggatttgatttttgcgctgtccataaatttagttggaaagcagggagcaaaacttctcgcaaaagaatttaaaagtatggataatttaatgaacgccacatatgatgatcttatatctattaatgaaataggggataagatggcaaatgaaattataaagttctttaataatgaaaagaaaatatctttgattaataagttaaaatctttaggagttaatatggaatatattaatgaagaaaacgaagatttgaagtttgaaggtatgacattcgttttaacgggaacattatccaaatataaaagaaatgatgcgaagaagataattgaaagctacggaggtaaagtttcttcttccgtaagtaaaaaaactacttatgttcttgccggtgaaaatgcaggaagtaaagaagaaaaagcaaagactcttggaataaaaataatttctgaagatgatttcgaaaaaatgatataaagaacttcttttgaagttctttttttatgtaaaaaatagataaattttgtaatattaaaataaaatgtattataatgtatttgtaacatcaaaattgagaaattaaaattatttaatttactgttacaataaaaaataaggacaagaataaatgacattaaaatattttttttcaagaccggaagatattcctacaaatttaacatggagtacatacggagttgaacatttaacctggcttattgctatagcattatttatagtttatatgtgccgtatatttaaaaaagccgattatgaaaaacaaaataaaatattaaaaatttttgcaatagttatagttatacaagaaatcattaaagatattattcatatttatgcaggaacttttaatcttgggcatttaccatttcatttatgcggtatatctatattttttactttttggtatgctttcaaacccgggaaaatttgcggtgaatatttatatgcgctttctcttcccggagcaatggcagcattattattccctgattggacagaatatccaatgcttcatttttcatgcataaattcttttaccattcatacatggcttgttgtatttgtatttatgcttttatatagcgcaagattaaaacctaattataaagttttgccaaagacagcattgttagttggtataattgccgttcccgtatattttatgaataaagcatggggaacaaattttatgtttttaagttctcctgcaccaggctctcctcttgagatactatataatgtgtttggaaatttttatattcctgcagctttgttgcttgttttatttgtttgggtgcttatgtatgctccatggcagatagcttattcgagacaaaataaaatggaagaaattgtataaagactaatgtaaaatcattagtctttttttattggataaaaatacttgaaaagcaaaatcaaaattaaaattacaaataaaattcagttaaacataacagtaaaagtattttattacatgaatatatcggattattatttttattatttaaaacactatatattgtgtatcttttctgcttgacaaagtaatatgcacaagatataattgaatacgttcagtggagaaatataattttattaatatatatggagaaataattatggtaacagagattttaaaaagagacggaagaacaagcaaatatgaaaaaagaaagataacagatgctatttataaggctgcggaagctgttggcgggcaggattatcaaatagccagagaactatctgatcaagttgataaaatattaaatgaaagatatgttgacattattccaactgttgaacaaatacaagatatagtagaaaagacactaattgaaagtggacatgctaaaactgcaaaaaattatattttatatagagccgaaagaaataaagtaagagaaatgaatacaactcttatgaaaatttatgaagatttaactttcaaaagttcaatagaaaatgatgttaaaagagaaaatgccaatattaacggtgatactgcaatgggaactatgcttaaatatggttctgaaggtgcaaaaaacttctatggtatgtttattttagatgaaaaacatgctgcagctcattcaaaaggtgatattcatattcacgatttagacttttatactttaacaacaacatgctgtcaaattgatttaacaaaattattcaaaggtggattttcaacaggtaacggatatataagagagccaaaagatataagaacttattctgctcttgcttgtatagctattcaatcaaaccaaaatgatcaacatggcggacaaagtattccaaaatttgattatgatttatcagcaggagttgaaaaaacttataagaaaatatatgtaactaacatgggtaaagcattggaacttcttgcaggtatggaaaacggcgaagaagtagcaaaagaattatataaagaaatagaagaaaaaagcggtctttatccaaaattagatgataatgaagagtttatgaagcttgaaagagaagctttagataaattggatcataaagatattgatacattgatttcatttacaaagaaaagctctctaaaagaaacagacaaagcaacatatcaagcaatggaagcattggtacataacttaaatacaatgcattcaagagcaggtgcgcaagttcctttcagttcaattaactatggaacagatacttcaagtgaaggcagaatgattataaaaaatattcttcttgcaacaaaagcaggacttggaaacggagaaactcctatattccctgttcaaatctttaaagtaaaagaaggaataaattataatcctggagatcctaactatgatttatttaaacttgcaatggaagtatctagcgaaagattattccctaacttctcatttatagattctccattcaatcttcaatattataaagaaggagatcctgatactgagattgcatatatgggatgtagaacaagggttatggccaatgttgataagacaaaagaaattgttacaggaagaggaaacttaagctttacatcaattaacttaccaagacttgctattgaagcaaagggagacattgataaattctatcaaacattagatgaaaaaattgatttatgtgcagatcaacttttacatagatttaaaatacaatgtgcaaagacagtaagaaattcacctttcttaatgggtgaaggtgtatggcttgattcagaaaaccttaaacctgatgatactgtaggtgaagtattaaaacacggtacattaacagttggctttattggacttgcagaaacacttacagctttagttggtaagcatcatggtgaaagtgaagagagtgaaaaacttggtcttgaaattgttaaacatatgagagaaagacttgatgatataacaaataaaactcatttgaatttctctttaattgcaactccagcagagggattatctggtagatttgtaaaaatggataagaagagatatggaattattcctggtgtaacagataaagattattacacaaactcattccatgttcctgtaggatatgaaataagtgcatttgaaaaaattaagaaagaagctcctttccatgcacttacaaacggggggcatataacatatgtcgaacttgacggagatacaacaaagaaccttgaagcatttgaaaaaatagtaagatgtatgaaagaaatgggtcttggttacggtgctattaaccatcctgttgacagagaccctgtttgcggatataacggtgtaatatatgacgaatgtccatgttgtcatagaaaagaaaatgatactgaagtgccttttgaaagaataagaagaataacaggttatttagttggaacattagacagatttaataacggtaaaagagcggaagaggcagacagagtaaaacattcacttaactctgaaatggaaagtttataggaggtaaaaaaatgaatacagcaaaagaactaacatatgaaacaaaaataggtgaaacaaacgtatatgtttacggagaaataaaggatttaacaaaagaagaaattaaggcatatattaaagatgttgaaaaacaaaaaaacagcgaagttcttgaacttaatttatatgcagacgaagatggttttattggaagaagtgcaaaagtaaaaccgattcctttcgacagaataagaagaataacaggttaccttgtaggaactcttgatagatttaatgatgcaaaaagagcagaagaatcagacagagtaaaacattcacttaactctgaaatggaaactttataatggatcaagaaaaagaaataagaattgcgggaatagtaagagaatcaattgtggacggtcccggaataagatttacactttttgttcaaggctgtcctcataactgtcctgaatgtcataatcctcaaactcatgattttaatggagggcaaattgtttctcatgaaaaagtgctaaatgcaattgggcaaaatcctcttttaagcggagttacattctccggaggagagccttttatgcaggcagaaagtttatattttttaggaaagaaaattaaggaaaaaggtttatctttaataacatatacaggatttagatttgaagagctgcttgaaatgaataaaaaaaatccatatatacttaaacttattgaacttaatgattatattatggatggaaaatttgaaattgaaaacaagacatataataaaacctttgttggcagttcaaatcaaagaagaatagatgttaaaaagacaatagaaaataattataatgtaatagaaaaagacttctaatgaagtcttttttattttgtgattatcattactgtttcttcgtaccatttaccttcaaagaattctcctttttcaagttttgaatgaggagtaaaacctgcttttttgtatgcggcaacggctctttcgtttactgttcttgggcatatttctacaaggtcggcatttttttcgttaaaaaggtatgtatacaatgtttttaaagattttgaaccaagccctttgctatggcccatgtgacctgctataaatatatctattccataggcatttttataattttcaagtttatgttctttgtatgcttccttttttaaagggaagaactgcatatatccgctgtcttgtcctttatattctattatacagcactgcatattttcctcaccatgaattcgtggaagatattttttctttagtccttcaagtgagttatctttgtctctacctccgtaaaacctgcttactctttcgtcatctctccacttcccaagcattgtaagttcttcatcggtatcttgtaattttctgatttttatgtcttcgctctcgcaaatatattctttcatcttctttctcctgttttttgggataaattttgtgtgttctcacatttgttccttttttacattgtaaataccaaacattgtatattgtgataaaataattatagcatattaatttattttgcttaattgaaaagtaaaaaatattgatatataataaatttataaatttgtaaatgaggtttgttatggaaaaaatagtagatttacatatgcatagtacgtattcagacggaacttttactcccgctcaaatgataaacatgatgaatgaacttggtgtagattatgcggcaataacggatcatgataatgtaaaggcatatgaagatattaaaaatacaacatttaaattagataaaccgataaacatcattcccgcaacggaacttggatgctcttttgatggtgttataagagatgtccttggatatgggattgatactaaggttatagatgaatttgtaagtgaaagatattctccagaagcaaaacttgaaaaacaaaaaagacttttaaatgaatataaaagagttttcagagatgccggaatagtatttgacaacgggcttgaagttcatagaggaaataaaagcgaagcgtatataacaatttacaacagccttataaaatatcccgaaaatataaagaagtatccttttatatctaaaattactatgtttttttggaattattgttcaaacagtgacagtaaattttttgtagacgaatcaaaggaatatcctacaattaaagaaggaatagaacttatacataaagcgggaggtcttgcctttttggctcatccgtgtatgtacagaataggcaaattaaggactcttcagcttataaatcatgccatggaatgtggtatagacggtatagaggttctgcattctcagcatacttttgatgataagttattccttgctgaagttgcaagaaagtataaactttataaaagtggtggaagtgattttcacggaggaacaaaacctgatataagtatggttaaaggaaaaggcgatttaatagtttcatataatatgattaaagattgggtagataaagtagataaaataatattaaaataaagaaggtgtttttatgaatatagatttgcatttacatactaataattctgacggtgatgacagtacaaaagagattatacaaaaagcaaaagatttagatataagtttaatctctattacagatcacgataccgttaatgcatatgatgatttaaaagacattgatactatgggaataaaaattattcctgcagttgagctttcctgtgcttatgaaagtgaaatgagggatatactcggatataatatagatatagagaaaatgagaaaaattttaaaaagtcttgaatccaaagaagaggatattaaaagagaaaaagaattattaacagagtatattgatgtatttagaaaaaacggaattatagttgatgatggtttaaaaatagaggacggagaaaaaaatgagggatataaaagaactattataagtgcattaggacatgaagaaaatataaaaaaatatccatctcttatgaatccgtcagcgtttttttgggataattgtgcaaataaaaaaagtagtttttatgttgatgaatcaagattttttaaaacaataaagcagacaatagatattattcacgaagcagacggaatggcattttttgctcatccttgtattcatcatatggaacatgatagagtggaaaaaatgcttgactatgcaagaagttttgggcttgatggggtagaagttttacatgcaaaacattctataaaagacagagaatttttaatcgattatgcaaataagcataatatttataaaagtggaggaagtgactatcatggctcacctaaacctgacataaagattcttacaggcaggggagatttgaatgtaagttatgatttaattgaaaattgggttagtaaaataatttaaaacggcgttttgccgttttttttttttacaaaataatgtttataaattgttaaggttttataaaaggaatttgtaattatttaatgatattttatataaaagattacaaagtattacgtatttttatggaggaataatcatgcaaaaattcatcaaagatattttaatggagttatcacgggaaggaattcttgtaagttataaaaatttgaatataaaggaggcaatccatggtataagttataattctacaatggactgcgaaaataagatttttgtatgcaagggatttaattttaataggttgtatctaaaggatgcgataaaaaagggcgctgttatatatgtgagtgaaaaagtgcattttgaagattttccttacataatagtttctgatgaaagaaaggctcttgctgttttatctaaaatattttatggtaaagaagttgaaaaattaaaaaagattggtgttaccggaacaaaagggaaaagtactacttccttttttataaaaaatgttttggatacgtatttgctgggtaaaagtgatattccttgtggtatcatatcatctattaaaacttttgatggtagcattacaagagatgccgttttaacaactcccgaatctttggaagtatataagactttaagtaatgcttccagtttaggtatggaatattttgtttgtgaagtttcttccattgcttataaatataacagagtttatggtattaattttgatgtaggagtatttttgaatataggttatgatcatatttcagatattgagcataaaaacttcaatgactatttttcatcaaaattaaaattaatagaaaatagtgaatatatagttataaatgaagaattgatgtcttttgataaggttcaaaatgcattaaaaaataaggataaaaataagattataacttatggcaaaagcagtaaggctgattatcagataatatcttcaaattcaaataatatgggtaatgcctttaaagtgaaatatggcggaaagatatatgattacagtattaaattaaaaggcggatataacatagaaaacgcagtagcatgtattgccgtatgtgatactttgggaattgaatataagtatatatataaaggaatattgaatgtaaaagtaaaagggagaggggaaatatataaaacaaaagatggtaaaaaaattatagttgtagattatgctcataacggacttagccttagtaagtattttgagtttatacacgaagaatatccgggaagaaaacatatttgcgtaataggctctacgggggataaagcaataaataggagaaaagatattgggcaaatttgtgaaatgaattgtgatgagcttattttaactactgatgattcttctaatgaagactttaatgatatctgcttggatattttaaaatatatagaagataaatctaaggtaaagataatagaagacagaacgaaagccattgaagaggctattaaagatagtcttgacgataatgtcgttatatcaattcttggtaagggagctgaaaacactcaaaagataaagggtaaaaagttattttatatttcagatagtatcaacgcaaaaaaatttgtggataaatataatgaagacatatcataaaaagaaaatgtaattatgaaaaaatttattgatatgtttaatttgtttttttcttatggcagaatgtgcaaagatgattttaacaataaggttttcaaaagcattgatatagctgttgttaacgtatcatttgaaggcaagaaaatatttcatagtgataaattatggataaatgatgtgttttcaggaattaaaaatgcaaaaagcaacttgtaagtagagtattcaaaacgaacctaaagtttagaagtatataaaaattgatataaaatatctcacaggcataaatacattatttatatacgtaaataaaaaagattagtatattgaacagcattatcaaggaattcatgaaatagattattatcctcataaaaaattacaatataatatgtattatgtaaaaaaaagcggtatatatccgcttttattttttatgttcatataatagtccttccatatatccacgaacttttattttttcttcgtaagttagtttagaatatatatttaaaaatattgattcttcaatttcgttatttgtatatgcaattatctgaccttatatcaaaatatatttttccaattattacacctaaacccaataagataagtaaagagccaactattaaaagttgactctttttatctttgttcttattattttcttttctttttaacataataagcaacaactcctattccacttataattaaaattcctccaattagttcaataatatgataatcatttattcctgtattaggaacttctactactactttttcattttccatagttgctttaacgatttctccatcttctcttatttcaaaatacattctttcttcattaagaatatatccttcaggtgcttccttttctaaaatatagtaacgaccatatctcatatctttaacaattatcataccttgttcatttgttcttcctgaaaatactaattcatctttatcgttatagatttcaattaaagtattaggtagaggagttccagtagataaatcaattttcgtaaattctagagttcctgtaattggcttatttttcatttctgcttttactacttcaccattttcttttatttcaaaagatactttttcatctgtaattaaatagcctgtcgcactttctttctctaaaatataatattttttacctgctactaaatttttaataattatcataccttgttcatcagttgttcctgtaaaaattagttcgtttgtatcttctgtataaacttcaatagttgtgtttggaataggttctccattaactaaatcagtttttgtaaactctaaatcgcctttttttaattcattctttaattgtaaagtttctgacacaatagcagttttattgtctatttcagttaattcaacaaaatgttctgttgtatctataacataattatctaatgttttagtttcttttattaaatactttccaagataaagatctgtaaatattgctatgccatcttctcctgtttcaatagatttaataaattcaccttttttataatgggttactccatctaatgttgtaatatcttcgttagcgtaaattgaaaattctacaccacttaatttaacatctttgtaagtaaattttccattttcaatagtaaatgcttctcctgttttttcaattacaacttcacccattattttatcattagcaaattctatttctatatatttaccatattcatcatcttcaataattgaactattttcatcaattctaaaaataacaccatcttgatttaataaatatccatcaggacttgttaattcttcaattttataagttccactcattaaaggataaggagtgataaatacaccattttcatctgttttaaattcacatatttcctctttgtttggatatgttactttttgacatacatattcatctgtatcaacatttttaattttaaatgttacattttgaaatggtataacttttccagattctgaatctgtttttactaattttaattttgcagtaattggggcatttgataatgaatatcttatggtttgtggtgaatttccattaacaactattttaaaatccttaactttttcgtgaccttctgttgtgttcaactgttttactgtataagttccatatacaagatttatttttgaatatccttgttcatcagtcttaacagttgtaacgtgattccccttactatcataaataccaaactctattccaacttctggttttagaattccagtttctgcacttgcataatatttatttatttctacatctcttttgataatttgttcatagacatttatagatgggtgtaaatcatcaactgtaatttcaaaataatatttatttgtatctaattcataccctgtgcttggactaatttctttcaaataaaaagttccaatatcgggtaaaattggactggtaacttttccctcactattagttgttaccttttcaactaactcatcatttagattataaattccatatactgctccctctaaagtagcctctacaccttgtggctcatttgtttgagtgtcattatcatttttatttactgtcacgtctccaccttttgtgtcaattttaacagaagcaactactggatctgaaaatctaaaataacccattttttgtgaattaactccattacctgtatatactatagttgtataattatcataatgttttcttacaacatttaatgtttgaactcctacttttaagggtgttacataaatattattaccttctattcttactgataaattatcagaactatacacttcatattcgcttaaaacattgtttgaatctgtgattttaatttcttttcctattattgcatcttgtgtagttccattaaaacttggcttattataatgagtatttactaatctcataatttcatttttttctgcatcaatattaatataatctccccaaccagaggcttcagtccaaaactctacaatttgtcctcctgttgtttcccaaatcaatgcttgtgctgccattctatatcttaatgtttgatgaccaggataatcgtatccataatgaccaatcaattcaatttttttacttatttcagcactatatggtgatgcttgaagaccatcataccctaaataacttgtagtagttatatcaactcctggctctatacaataaacagtttttccatccattgtataagtttcgtattgtgcagacatataaggtttgccaccaccacgtcttgtataatatacatctggaacttttggatgagataaagttccacttgtagcagcattaactattgttggaatagcaaatgcgaatacttcaaataaggtcagtgcaatcaataacactgatactatttttttctttttcattcttatcatatcctttctaaaaattaaaaaaacaaccttttacggttgcttttatcaaaataaattattccattggatttgtataatcaatatgcaacttataacctaaaactttgcctttataaattacctcttgacaactaaatcctaaaatattaactgtgtccgaaaatgccttttcaaaacctgctttttgacattcctcataagtagcatattcaacttgtttttttaacttttctaattcttcatctatcagtggaggttgttcttctttaggcacctctattgttgtagattcttgtttttcttcttgaacttgatttttttcatcattttgttctgttttaacaggttggttactttcatttttttgaatattagaatttttttcttgtgtattttcttgaatagtttcattactttcaccagtattttcctctatttcatcaatgatttcacttgtttctgtttcgtgctcttttttaacattcttttcatcatcaagttcctgattttcttctactacaacatcgtttactgtgtctttcttttctgctttttcaataaaattgttgaaaagaagaaatattccaacactactcaaaataagaattatactgactgaaaaaagtattttcttgcccatatctatcactcctttagtgatattataatctaaactttttaatcttgcacttctacaattttctttcagttagtaaataacagttagtaatatatactagggtggattgtaaggagggatttgtggaatacaaactcccattatcttgcatccatagacttttgtctttgcaagtgtttgttataaaattcaatcgcattcacaacataatcttcaatttttttatcttcaatgttttttgggagtacacttcttattctgttttcattgaatttcattttgggaacctgattaggcttatcttctgacattatactatcaatagtttcttctgtaagttttccatcttgacttaattttttcattttaattgcctgtgcgtgagatggagtgcaactattgtagtctatgcaatccaacaaaaagtattgttcttcttttgttagataagacaattctattgcaggaagaaaagcaatatctttattatctactttatcaagtaattctggtactaattcagttagcctaatatatctttgaacttgtctgccactttcattatactctttacctacttcatcagcagtagtcaacttctcgacagcctgtcgagaagttaaatcatttctttttccttgatgactaagtgcttctaatttcattttgtatgcaaaggctttttcactaggtaaaatttcttctctttgaatattgctatctaccattataatagttgcttcatcatctgttaattctcttactatacaaggtaaggtatctttattggctaattcacttgccctttttcttctatgtccagaaatcatttcatatcttccattaggctttggtcttactaaagcaggaacaagaactttattttctttaatgctatctcgcattttttccatatcttcattgtctataaccttaaatggatgatttggaaaatcgtcaatatctgtaatttttatatcaacaactttttctaaactagcaatatttctttcttcttctgtcgtaaaaaggtcatctaactttggtagtggcatttttgataggctctttgccatcgttaagcacctcctttgcgaatgaagaatatgcttctgctactaatccatttttatcataagagaaaatgctttctccttgtgaagtagattcagcagttttaatagcacgaggtatttgagttttatataactttaacatactcccataattctctgttatctgtttttctatttcttttgaaagattagttcttctatcaactaatgttaataatgctccatcaatttttagtgtagggtttatttgtcttcttactttgtttattattttaaacaaatcagtcattccccttaatgcaaaatactgactttgaactggaataagaacactatctgcacttgcgagagcatttatagtaagcattcctaaacttggctgacaatctaaaagtatataatcataatcatttcttacaacagataaacaatttcttaaagtatattctctactcatagcataggctaatgaattctctaacgcagacagatttaaactagaaggaattaaatctacattttctttatggtgcaatatacattcttttgttttaatttcatcatcattcattgattgctccattaagtctgataaagtgtattttaattcatctgagttgtaccaacctgcataggtcgttaaattactctgtggatcaacatctactaacaagacttttttcccctgttttgctaatgctactccaagattaaaagtagtagttgttttaccaacgccacctttttgatttgtgatagcaattaccttgcacttactttcttgcatatattctcctcctttcttttaaatttagccattctacaattaagcaaaatggctatgtattccatctctggcacaaaaaaagaactgattcctctaatcagttcaatatgtttaatatgttattttataatatgattaataagtagtatatctaccaaatctttggataataaatttttaataataaagttatataaataaaactataaaatagttaaaattaagatttaatccttgtaacatatctaaaggatttaatcttgaaactagtatgtggaaacatattacatacatacaaccctatttttacaagttcaaaaatttttacttttttcacttttttgaattttttttattttcaaaactccttattttactgggcttttcgacttagcactgacacacattcaacgtgccctgtctgagggaacatatcaacagctctaaccttcttaacttcataccctgcttcaataaagaaaggtaaatccctaattagagaagttgccttacaacttacataaacaaacttcttaggtttaaaagagattattttgtctattgcctttgagtgaattcccgcacgtggtgggtcaagaatgataagatctgattctacatcaattttatcaacttcctctaaaacatcaccgcatataaatttacaattatatattccgtttaattttgcatttacctttgcggcttcaattgcttcagcaacgatttcaatcccgtaaacttccttagctttgtcacttaaaatttgagttattgtacctgtaccgcagtaaaggtcaagtattacatcgcatttatcttcaccgataaagtcttttacaacactatataatttttcgctgccaagagtatttgtttggaagaatgaaaatgcagaaattttaaaatcaagtcccaagcatttttccattatataatctctgccataaacaatatttatttcatcagctaaaacagcatctgaaaaagaatcgtttatagtatgcattattcctacaatctctccctttaaatccaagtttaaaagaatatctttatattcatttgtatcgattttatcctgtgacgtagtaactaaatttacaagtatttctccagtatatgatgcttttcttattactaaatgtcttaaagttccttctttagagaatttattgtaatgttttatatttttttgagtaaaataatttaaagtgttaaataatatttttctgtaatcttcatcaacaataagacaattttctgttgaaactatattatgatgtttccctttttcatgcattccaagacacaacggtccatccttttccatatcaccaaaagaaaactccattttatttctgtattctgtctcttttggagatgcaataataggaagaaactcttcgtattctatacctgccttatcaaaaagtcctcttacataattttcttttaattcaagttgcttttcataagaaatattttggaaagaacatcctccgcatattccaaacttttcgcacataggctcaatttcataatcagccttcttaattattctgttaatatttccttcggctctgttttttcttactttctttatgaatacttccgcaacctgtccggcaagtcctccttttacaagaacctttttatcttcataataccccatggatttttccattgatacattttctgttatgttaagttcaattatatctttctttttcatatatacctcttttatttcaatttaacatctttattttacattataagacgtaaaatgtaaaataaaaaacacaggttatttacccctgtgtttttctttcttctttctttgtttcatagagaaaagttccttttgtctttgtcttgcttctaacttcatatttttctttacattagtttttcttgattcatattgtttctttagaagctcttgtgattttgtggaaatacttctcccattcatttctttactaatcattctcttaattcttttaggattagttacttgttttatattactttcaaaattttgagcctgataaaattttaatttagaataatgaaaattataaaattcataaatttcattatcagtaggctctttcccaaatgtaattttacaaatttcaaaagtcttattaaaacgtctttccactactcccacataaaacggactttcaaaatataccgtaagttttacccttacttcatccaaagaaatccctccttttgtttattaaacaaagaacggacaaccaaggaggcaggttacttataactatagttatgcccggactaccaaccgcgctgtgtttttatctttgcaaattttatattatacttatatattttacttgtcaacaaaaaaagaggtgttttatcacctctttaaattattcagctttcaatttaccaagaaaagctttcattcttttattttcagagctaaatacttcttcaggagtcccctgttcttcaatataaccattatccataaatattatgtaatcagcaactttccttgcaaaatccatttcgtgagttacaatgaccattgtcatatgttcacttgcaaggtcttttattaccttaagtatttctcctgtaagttcaggatcaagtgcagaagtaggttcatcaaagaataatatgtcagggttcattgcaagagctcttgcaattgaaactctttgttgctgtccaccggatagttcgcaaggatatgcattttctttatcctcaagccccatcttctttaaaagctctcttgcttctttataaacttcttgtttatttcttttttgtactttaataggtgcgtttgttatgtttttcataactgagtgatgagggaataaattaaaactttgaaatacaagtccaaatgtcccatcatatgaaattgtaccgctgtcttctttttcaagatttgtggcacatctaagtaatgtggatttaccagaccccgaaggtccaattatacaaagaacttctcctttatcaacacttagagaaatatcttttaaaacttcaacaccattaaaactcttttttaaatttttaatttcaagtaaactcatgatatttctccttatctataatagcttaatttcttttcaatatattccattacaaaagcaacaacaaagttaaatatataatagaaaattcctgctgctataaatgccgcaactgaagattgagctgctgcaatttgttttgcaactgtaaacatttccggtattgctattacaaatgataatgaagtatcttttacaagagtaataacttcattcgttgttgcaggaagaattctttttattacctgagggaaaataataataaagaaagtttgaactttattatatcctagaagtttagcagcttcatactgtccgtctggcatagattctataccccctctgtaaatttccgcaaaatatgcggcgtaatttatcgcaaaacctattagtaccgcaaccattctataactgctggaaatctgcataccaaatatataataaggtccccaaaatacaaccattaattgaagcattaaaggtgttcctctcattattgatatgtatattttaaataaccatctaattggtgttatttttgacattcgtccaaaagctataattaaacccaaaggaagagaaaaaatcaaagttaggacaaatatctcaatagaggttatcatcccactgcttaattcactaaacattgttcctaaatccatacagtcatactcctaataattttaatctatgttatttaccgatacaaagtgaaccaggtacaccgaaatcagcatatttttctgctattttatctatagtaccatcttttgccatttcatctaatgttgcttgaactttatctctaagtcctgtattgccttttttaaatccaactgcgtattgttcagaagaaataatttcatctaaaataataaattcagatgcttttcctcttgagttaatttgataatttgctacgccaatatccattgctattgcgtcacaagcacctgcttctaaatccataaaagcagaattatagtctgcaacttctgtaagtgttgcaaaagttgctgctaaatctttttgatctccttgtaatgctgctaaagctgaagaatctttttgtgtttcaactgttttaccttttagtccagcaaaatcagtaattcctgagctttttgaaacaacaactacttgtttattatctatataaggttcagtccaagtataatcatcttcacgaccattcattgtaaaaccattccaaatacaatctattgttccagaatcaatttccatatcttttgaatcccaatcaacaggttgttttacaagtgtccaaccatttctatcacaaacttcttgtgctaaatccaagtcaaaacctacataatttccatcagaatctttatatccataaggtggaaattctgcatcaaaacctacaacaaaagtattttcatcatttgttacttctgattccttgcttccacaacctgttaaagtcatgcccgcaactaaaatcaaagcaagtaatactactaattttttcttcataataagtacccctttaaatttttattactatataaaaatagttattttattctaccataatttcagattatttgcaatattcaaacaatttatattgcaatataaaaaagaacaagaaggattaatccaacttgttctttttatttttttcacttatttcttattagtttaatttattcttcttaattaatacaaaacttattgttaaagaagcaatagctgaaagaacaaataatgaagtccataaagctatattattttcatcagctgtattaactgtttcaacacttctgctttgagcattattatcactactttgactttgtgaagctatagcagaatcttctgatttacctacttctacattacttttatcacctgatgaaccgttattatcattattatttgttatagcattatcacccttattatcgttatcgtttgtattgttagcatcatcttttggatcatctgttgtagacgtactattgttattattatttgcatcgtttaatgcaataacataaggagagaatccatcaacatctatttttacttgaccatcttctactttagctttaaatgtttctgtaaatactacgccatcaacttcagcaaaatgaagtactacaacctcttcattattgtatttttcatctacattaaaaccaagtgaaacactttgtccttcttctaattcattacttaaagaaatatcatatacacctaaaattgtattattttctactcctgcagttaattgatcataatgactatcttgttcgttaatttcttcaactaataattttgtatctgtaggtaaaacaccattaacaaatatacctgtatttttatcttcaagttgttgttctataacttcaactttattatcttcattaccattattagatgaaccgtctgtatttccttgattatcaccttcttcaggttttgtaacatctccgccatcacctgattgatctccattgtcaggatcagtcacagatgaacctgagtcattaccgccttgagatgtattatcatctttatctggattagtaacatcagtattatcattatcttctttcacaacaacattaactgttgcagttgcattctttgttgtatcaacagttgaaacggctttaactgttattgttttagcagtttcatctgaagcaatttttaataaacctgtagaacttatttttgtatcagagcttttttgtccgcttatactccattttactgtttgagcaggacttccagttcctgttacagaaacaccaaaagttttactacttccttgctctaaatcaatagttgttggattaatagcaactttacttacagttacagggtcttttactgttattttttgagtaacattttttgtaaccccgttatatgtatagctaattgttacacttgttgttcctgtttttaatgaagatgttgaatattttacactttttgtaacatcacttgtagttccatcactaaattttgctttaacaaccattcccgttgaatcaaatgtttcccctgctgtatatgttgttttctttggagcagttgaaattgaaatagaagataatgatttgcttaccgctacatcacttcctttattaacaatagttacataatcagaagaaatataagcatacatactgtcaaaatcatatttaccgttactgcttatagctgttctaccagaatttaaggcaggttcactttgaattttgtagaatgaatttgtagcttttgaatttaaaattaaaacagcataatttgaatatgtatcagtattatataatactttacctgatgtgcttgcactgtttcttacattaacactattatgatttgtattgatagtatcttttataccaatagtatattttccttcatcttttcttccgccgtttttatcaagagtatatgccatatttgcagctttttcaccccaatatgggtcagaagcatagctcacgttaataccgcttcctttattacctaaaaatccacctttcattctccaatcatttggattaagataaccttttgacatataagattcagtaaactgttttatacattcatcaatacttgcatatgtactagcacttgttccaggagaactatccacagcatttaaaccaaataagttatttttatttttacaaatcgaacttgtaccccatgcactttcatttccggctactccgatagccaacaatgcatttacaccatatgtattttgatattttaaaaatgtacttgctgtacttttcatctttgaagaagatgaagtataatcacttatttttgcatttaacaatgaatttaatgaacttgaactgtatgatgtttcacttcttaaaggaaggtattggaagtaattatagtatggattacttttatttacagaatttgtacgaacacccttagtataatcagtaagcatagtactataacttgtatagaaataatgtccatcataactataataagttgttccgctctttaaatatgatggtgcagcaccattatccaaagatgtagcatgtccaggtgtggtcatgtcacatgtaatgtagtgaattaatcttccacctgatactttataacaacttgatgattttgcacttgaaaaattaataacttgtacatcgtcttcatctacccagccaacaacacctgaaagcataaatttaactttaccgttgcttgttccaagatatgcagcatcagctccataagcaccattagtataacctgaaacacccgttccaacttcagtatagttagttacggcgttaccttttgttctaaaatttacaatttttacagatgtactttttgcactaaaagttgaaatcccgttactttcaactttaccgctatcatcgtcttcaacattataaacatccccatcagtatctacacctgtagcctgatcaagttttgtttggttttcgtcttctaatcccgaagcagcatttacaacactgaaattttgaaaactaaaaaccattaataaacataaaattgttaaaataaaagttcctaaattttttcttatttttgtcacggtcgtaccccctttaaagcttaatcctctttagacaataatctacaataaatatatcattatttccattttttttcaattaaaagttacataatacacacaaatttcacataaaaaaataactatatactatatattgtacatatattacatacaaacacaaccataaatatagttattacatttttatatattgtttgtaacattatttttatataaaatatttgttatatataaaaataatgcaaaaacctccttactttttagtcattttaaaagatatataactttatattttgtaaaatttttattgcattaaaacttactattcgttaaatattaatatatgtatactatcacctaccctatcttactatctgaaatatcatataagcttatatatatttcaaacatataattatttttaaataaaaaaaagcatcattaaatgatgcttttttttgtatttgaaatatttttattatttatttttagttatattctttatagcatataaaacagctaccattagtactataccaataggaagtgatacccatgctgtttgaacaaaacctgcaataatgtatgttacaaaagatacggctgctacagtcatagcataaggaagctgagtcgatacatgattgacatgatcacatctggcaccagctgaagacataattgtcgtatcggaaataggagaacaatggtctccacatacagcaccggccatacaagccgaaattgatataatcataagttgaggatttgaattagcaaatacagaaactactataggaataagtataccaaacgttccccaagatgtacccgttgcaaaagataaaaaacatccaaccaaaaatatgattgccggcaaaaagttcattaaagaagctgcgttattttgcatcatacctccaacaaattcagcagctcccaaactatctgtcatagctttcaatgtccaagcaaaagtcaaaatcaaaatagcaggaaccatagctttaaacccttctggaatacaatccatacattcattgaatttcaaaacttttcttgcaacatataaaataacagttataaacaaagcaaatatactacctatagataatcccacagatgcatcactgtttgaaaaggcttctataaatcctgctccggaaaacaaaccgccagtataaaccattccaataatacaacatattataagagaaattataggaataattaaatcaattactttaccattttcatttacttctgttgtttcttcttctacaaaacctgcatttaaaattgaatgtaaatctccttttgaagcgttttcttcatgctttttcattggaccataatcaaatttgagtaaaaccaaagaaatcatcattgtaattgtcaaaaatgcataaaagttaaaaggaattgcctgaataaatacagaaaacccatcttcccccggaacaaatccagtcacagcagcagcccatgaagatataggagcaataatacaaacaggagctgccgtagcatctataagataagcaagctttgctcttgatactttatgtttatctgttattggtctcataacgctaccaacagtcaaacaattaaaataatcatctataaaaattaatacacctaataaaatcgttgctagttgagcacctgcacgtgtttttatttttttacttgcccagttaccaaaagcagcagaaccgcctgctttattcattaaggcaaccattcctccaagaacaacaaggaaaattaaaatacctacattgtaactgtctgaaagaacagcaataataccatcatttaatacatgagttacagttccttcaaaactacctgcagcataaaaaataccgccaaaaacaatacctataaataatgaactgtaaacttcttttgtaataagtgcaagaacaatagcaataattggaggaactaaagaccagaaagttgcatacatagctggtttagctgcttcagttgtttctgcacctaagattgggaatactaacattaaaataagcataaagctagcaatacccgtcattaatttcttctttgaaattttcatcgtacaccccttcaatgtatttaaattatgtaaataaagacaaataaaaaagccttaaatgacatcactttaggacgcattcatggcaaaataaatttactgtcgatagcgctccacaatcgtgacagtatattacatattatgtaatataccagaatataaattatttgggtaatatatattcttcggcagtatcccctttcctttatataagtcccaaaatataatataaagtactgatgaacaccgcacctctatcattttatatttacctttcttttttaccatttttacataatattgtcaagttttatttaatatatgacaaatttatcaaaaaattttttacttttcgcttaacattatatagtcatctttattttccttataaattttaaacccatatttcaagtataaatcttttgcataattatctttacttacagataaggatacactatcatacattggttttaaatttagtaaaaatatttttaataaattttctccaatacctttatttctgtaatttttttctacagacatacataattcaggaatctctttcgaaacatatccatatccatgtatattatcatcaaacaatatgctccaaatcatagcaataatttttcctttatgttcacatacataacaaatatctttatttaatttgaaattctcataatatattttaatatttggatcttttaaaatatcttttgaaattgtaatattatttccaacataaattgcataataagtaaaatctttcaaaaaatatatctcattaccttttatttttcttattttatagtcttcattcatatatttaaccttcaaaaaaaaggcacttataaaagtgccttttagtaatttttatttcttagaattttttattctagcttgagcagcagcaagtcttgcaattggaaccctgaatggagaacatgatacataatcaagtcctacactgtcaaagaattcaatacttgcaggatccccaccttgttcaccacaaacaccacagtgaatatctggattaacttctctgcctttcttaaccgccatatcaacaagttgaccaacaccttcagtatcaattgttgcaaatgggtctttagggaaaatacctttttcaatatattctttaatataaaccccggcatcatctctactaaatccatatgtcatttgtgttaagtcatttgtaccaaatgagtagaattccgcaacttttgcaagttgatctgaagttaatgcagctcttggtatttcaatcatagtaccaactttgtaatcaattttaattcctgtttctttaaatatatcatttacagtttctcttattctgtcaactacatatttaagttctaaataactacctgctaaaggtaccataatttcaggagtaatatctaaattatcttcttgttttgcttcgattgcagccattatgatagctcttgtttgcatatttgcaatttcaggatatgttacagcaagtctacaacctctatgaccaagcattgggttaagttcatgaagttcgtttactcttgcttttaattcttcaaaagttaatcccatgtcttttgcaagttgcttaatatcttcatcttctttaggaaggaattcatgtagtggtggatcaagaagtctgataacaactggttttccacccattgctttaaatagacctttaaaatcattcttttgcattggtagaatttcagctaatgcatcttctctttgaattaatgttttagcacaaatcatttttctaaaagcaaaaattctatcagcttcaaagaacatatgctctgttctgcataatccgataccttctgcaccataattagcagcaacagttgcatcttttactgtatctgcatttgttcttattttaagtcttcttatttcatcagcccattccattactttattaaagtcatctgataaaacagcatctacagttttaatctttccttcgtatacattacctgttgaaccgtttattgataaataatatccttcatagaatattttaccgcctatttcaacatatttttcttcttcgttaacatgagcagcttcacaaccggctacacagcatttacccatacctctggcaacaacggcagcatgagaagtcatacctcctgtagcagttaaaataccatttgcagagttcataccttcaatatcttcaggtgaagtttcttttctaacaagtaatacttcttctcctctttcttttgcttcaacagcatcttctgcagagaagtaaattttaccacaaccggcacccggagaagcaggaagaccttttgtcaaaggaatagcttttgctaactcatcagtatcgaaacctttatgtaacaattgatttaatgttgaaggttcaagtcttaagatagcttcttcttttgtaattaaaccttcttcaaccatatcaaccgcaacttttaatgaagcttgagcagttctctttcctgcacgtgtttgaagtaagtataatttaccctcttcaattgtaaattcaatatcttgcatatctttgtaatgattttccaaaagtttacatgcactgataaactcatcataaactgaaggcattacatcttttaaagtatcaatatgttgaggtgttctaataccggcaacaacatcttcaccttgagcattcatcaagaactcaccaaaaattttattttcacctgttgcagggtttcttgtaaatgcaacccctgttcctgatgtttgtcccatattaccgtaaaccattgattgaacgtttacagcagtaccaatacgatttggtatatcatttaattttctataagcaatagctcttgggttgttccatgatttgaaaatagcttcaacagcagccattaattgttctttaggatcatctgggaattcatatcctttttgatctaagaataattctttgtattgttttacaacttgttttaaatcaaaggttgtaagttcggtatcatatttgtatccctgttgttttttccttgttgtaagaatatcttcaaataaatttctattcattccaagtgcaacatcacaaaacatttgtataaaacgtctataactatcatatgcaaatctttcgtttcctgttttccttgctaaagcttcaactgttctgtcgtttaaacctaagtttaatattgtatcaagcattccaggcattgatatctttgctccagaacgaactgaaaccaacaatggattttcaaccccgccaaactgttttcctgttatttgttcaagttcagctaatttttcataaatttggttgataatttctttatcaatttcacaaccggttttgtaataatctatacaagcctctgttgtgattgtaataccttgaggtacaggtaaacctatacttgtcatttctgccaagtttgctcctttaccacctagtaaatctctttggcttgcatttccttctttaaaggcataaacaaattttttagcacacattttaaccatcctcctcaataaatgtttatgacattacacagtaaaaaactgtaatatttataataagctgtaaaacagcatattaactagtttttatattgaacttcaaatccttcataagatggaagtcttttttcatgaaatctttttaaaatttctcttgcttcatatgcaataacaccattttgttttttatgtcttgcaaaatatcttaaattttccaaagcttcatttgtattaaaacctgttctaagacaaataacacttgctgaatatttaagctcataactgccgtttttacattgctctaataaaaattctttatatttatcaaaatcttccaacataatatcaattataatcataatatctttattggtaatgtttgcatcaacgatacgtttttgttctaaacatcttgctctgtaatctattttttctttaaaaagttcaagtatatctccttctgcttctatttgctctctagtcataggctcaatagtttttttcttttcaattttttttctaagccttaactgttttttttcttctttttctctgttatgcatgttgataatatcttttaatgacatacttttctcctttaaatatataatttaaacttttacattaattattaatattattttactatattttttaaacaattacaatacgaataccccataaaaaaaatattacacttgccatgtttatataatcatcacgacaaatgtaatatttattaaggttattaattaaaacataactttttcgctaatatatttaactaaatcttcaatctttattctttcttgttccattgaatctctgtcccttacagtaacagcaccatcttctaatgtatcaaagtctattgtaacacagtaaggagtaccgatttcatcttgtctacgatatcttttaccaatattaccggcttcatcataatcaaccataaaatatttagaaagctcagcatatacttcagttgctttttcagataatttctttgttaatggaagtactgctaccttataaggagccaaataaggatgtaatttaaatacgtttctggttgtattatcttctaaagtttcttctacataacaatcacaaagaagtgtaaagaataatctacctgctccaacactcggctcaatacaatatggatggaatttttcatttgttataggatcaacatatttcatatctttacctgagaattcttcatgtgatcttaaatcgaaatcagttctgtctgctattccccaaagttcaccccatccaaaaggatattcatattctatatctgttgtagcatttgaataatgagataattgttcttttgcatgatctctgaatcttatgttttctttattaattccaagagaaactaagaaatcaaaacaatattgtctccagtattcaaaccatttcatttcgtcttttggttcacagaaaaattcaagttccatttgttcaaattctcttgttctaaaaataaagttaccaggtgtaatttcatttctaaaagacttaccaatttgtcctataccaaaaggtaatttttttcttgttgatctttgaacgtttttaaagtttataaaaataccctgacaagtttccggtcttagataaattgtattaacactgtcttcagttacaccttggaaagttttaaacattaagttaaattgtcttatttttgtaaaatcgtgtttaccgcaatttggacatactatattgttttcttcaatataattttccattttttcattgctccatccatcagcatttgcatcaagaccttttttttctaaatcatcttcaattaatttatcagctctaaaacgagatttacaatttttacaatccattaaaggatcattaaagtttttaagatgaccgcttgcttcccaaacttttggattaaccaaaatagcactgtcaagcgcaacattgtaaggtgattcttgaataaattttttaaaccatgcatttttaacattatttaaaataagtgttccgacaggaccataatcaaaactatttgcaagtccttcataaatttcagaacctgggaatattattcctctcatttttgtaatacttattatttcatttaaactaagccttcttgtcatttcttcctccattttttatttattgcatatattaatttaattctatcatatctgataaaaatttaaaactatttgttttcttttgaagattataagttatataattattcaaaattacaattatattgttacattcctttaaagaaatatttttaaaatcaacttttttaatatcctttaagtttatataagtaagttcattgattaaatttatttgttttaaagttaatttatttgatgaaaaatactttgttgtgcattttttgcaagacaacatactgctttcaaaatcaaggtagtaatcactgctttttgcatcaccgcatatgttacaatatttaaaatcaggaataatccctgaaataccaagcagctttaacataaacataagagctacaaaagatatattttctattttacatttttgaattaaatccaaagtataaaataaaagattaaaagttatttcttcttccattttatcttcataaaatatatcaataagctcacaaatataacttgcaaaagaaagtctttcaagatctgtttgtattcccggaaaactttttatataatcagcactttttaatgtataaaaatttttccctggatataatacaaaataactataagaaaacgtacttgtttgggctattaccttacttctttttgaagcagcgttttttgccataacgcttattttacctctttcttttgtaaaaacagtaagtatcctatcattatccgaatattttatattttttataactataccatgatattctcttaacataaacccctcttagaaaaactattttttccatgttcccggagcaaataaaattaaaagtggaaacaattcaagtcttcctgctatcatatcaaatgataataccaattttgaaaaatctgataaaaatccataatttgttgcaggaccaacaaggtttaatccgggacctatattattcattgtagctgcaacagcactaaagttcgttgcaaaatcataattatttaaagatataagtaataatgataccgtaaaaattatcgtataaatgaataaatatgcacaaacattatggaatgttttcttttctattttctttccatccattttcattatttttactcttctcggatgaataagcattgaaagttcattaaaagcatctttacataaaataataaatctgcttacttttatacctcctccggtacttcctgcacatgctcctataaacattaaaattaaaagtatcgtttttgaaagctgtggccataaattaaaattcacacttgaaaaacctgttgtagtcattatacttgcaacctgaaaaagtgaatgatgaaaagccatccatattgaagaataatctcctctaatattaaaagctattacaatagttgcaagagcaattatggctaaataacatcttacttcttcatttttaaacgctcttgttatttttttcccaagtattaaaaaataaatattaaaatttactccaaaaagtatcataaaaatagaaatgacaaattgacaatatgtattatacaaactcattccggcattactcattgaaaaaccaccggtacctgcagttgccatggaatttaaaatggcatcaaataaaggcattttcccaataatcaaaagaataacttctataaccgttaatccaaaatatataccatataaaatcataggagtacttcttaatttaggcattaatttacctaccataggaccgggagattctgctctcataagatgcatattttgtccccctcctatcaaaggtataacggctattataaagactaaaactcccattcctccaagccaatgcataaaagaacgccaaaacaatgtacatttactcaaagcatccacatcggcaacaacacttgcccctgtagtagtaaaacccgaagaactttcaaaaagagcatcaaaaaaaactggtatttctccgcttaaaataaaaggcattgcacctattaatgctattataatccaactaagagcaacaatcgcatatccttcttttgcatatatcacctgatttttaggctttttatatattaataatagacctattataaaactaatcaatgaaatgataataaaagaatatcctgttgtttctttataaattaaagcaaccaaagttggaagaagtaaaactatacccatcaaaataaaaacccaacctgtaatatgctttatcattcccttattcatattaaatctccaaatctaaatataattaatttcttactatatctgttaaatctcttaatttcttatgtgttgttacaattattacactgtccccgacttcaatagtatcagaaccggaaggaataattaaattaccatttctgcttatacttgcaaccaataaattatctttaagctcaagttcctgtagttttatacccgtaataaatgattcttcttttacactaaattccaatgcctcaacctgtcctccgacaattttatacactgattctacattactgcttaaagaattctgcattgctcttacatattgaataatatattcacttgtaatatatttaggctctattacactgccaatatccattttgctaattatattatcaaaagataatttatttatttttgtaataattttagcattagatacacttgccgcatataaagataaaataatattttcctcatctaaacccgttagtgaagcaaaagaatcaacggtggcaagaccttcttcaagtaaaaattctttatccaagccatctccgcaaagaattgttgcatttggaacaatatcacttaattcttcacatctttctgcatccatttctacaatttttacagaaatattactcgaaattaagaattttgcgagataaaccgcaatttttccaccaccaactaaaattgcagttcttcccttttcaacgttaatatcaaaaactttaaacattttcattgcatcagcaggttttgataatatatatattttatctaaatttttcagcataaaatcaccggatggaatataaacatcatcatcacgctcaattacacaaatttgaaaattacttttatcttttacattaatatcttttataagtttaccgtctaattttgatttttcaggaatttttaatttatataattcaactccaccttttgtaaatctgttaatttcaattgctccgggatatctaataagccttgaaatttcatttgccgctgtaagttccggattaatacaaagtgataatcctaaatcatcttttacaatatgaatatcttccgcatattcaggatttctaactcttgcaattgtattttttgcgcctgctttctttgcaattaaacaacaatataagtttacttcatctaaacttgtaacagcaataagtaaatcacaattctcaattcctgcttcatttaaaatgctatttgttgcgccattaccttcaacagtcattatatcaattttattacttaaagtttcaagtttatcagctcttctgtcaacaacaacaatagagtgaccttcatcatgcaaatgttctgcaatagtacttcctactttaccacaaccaacaattataatattcatagttaattccttttctttatttattattatatgttaaatatattttattttaatgttacaacagtagcaccatctccaccttcacctatatcaccaagtctgtatttttttacatatggatgattttttagtagttcactaacggctttttttagtaccccggtacctttcccatgaattattgtaacaagttttaagtttgctaaatatgcatcatctaaatatttttccacttttaaaatagcatcatcagcatacattcctcttaaatccaaacttgtttttatagttttcgcttttgtatttgaatatttaattactgatttttgtaactgttctttttctctttttgaaggctctattttagaaattggaatttttgtttttattataccagcttgaataaacacattatttttattatcaaatccaagtattgtcgcatattgatccaaactttttatatatacttcctgtccagctttgaaatcctcttttttgttttgtttgttctcttgtttctttatttcatgagaaggaatataagaatttaaaagttcttctttttcttttatttggtttttaattttatcaatatcttttttatatttatcattattagcattaacattttttggaatgctaattctatttaatttgtttataatttctttagactctctttttgcatctgcaataatatcttttgcttttaaagaagcatcaagcataatttttgacttattgttttctatatattctttttcttttgttaactcattatttaacttctcattttcagctaacaatttttcaacttcatttttttctttttcaactaaagctgttttgtcattaagttcttttataagctgttcgatatctctattttctttttttatatttttcttagctttttcaattattgaaatatcaagtccaagttttttagaaatttcaaatgcattggatttacctggaataccaagtattaatttatatgttggagataaagtttcaacatcaaattcaacgcttgcattcattacatcctttttagttatggcatattcctttatttcactataatgagttgttgcaaaaacttttgccccgatatttttaagtctgtctattattgcaacggcaagagcagaaccttccacaggatctgtgccggctcctaattcatctattaaaacaagtgttttatcatttgaagaattaacaatatcaactatatttgtcatatgagaagaaaaagtacttaagctttgagcaatactttgcttatctcctatatcagcaaaaatattttcaaaaatcggtagacaactattttcatttgcaggaataaaaagtccacactgcattaaaagtgaacataagccaactgttttcaaagtaaccgttttcccgcctgtatttggacccgtaattatcaaagctttaaaatctttatttaaaacaatgtttgaaggtacaactttgtttatatctatgagaggatgtctggcttttttcaaatcaatcgtgttatcttcacttataataggtttactgtattcgttttttatacaaaaatctgctttagcatttaaaacatctaaatataaaagaatattttcgttaaattttaaactgtttgcattttcttttacctttaatgataaaatttttaaaatagtttcaatttctttttgctcacttatttcgagttcttttagcttgttgtttaaattaacaactgcttcaggttctataaataaagttgccccactttgagatgtatcatgaacaatacctctaacctcacctttatattcagattttacaggaacaacatatcttgaatatcttatagttacaatattttcacttaagtatttttgatacttatttgaatttataatactgtttaatttctctcttattttattatttgtattctttatatttcttctaatatcataaagagtactgctggctttatcacttatggtttcactgtctattattattctatcaatttctttttgaagataagataaatcttcaatgttattagcataatcttccaatgtaggataagtatcttcttgcgacaaattagataaaatatgtttttttaccaaagtagcacattttatgctttttgaaatatttataaaatcatcatttataagtattccgtctttagatgcccttgatataatatctttattaaccttatatccataaataggaagcaatgaaaaagaaagagaaaatttaacaagttcatcaagttcatttaatttatcagaaattaaataaatattatctgttggcaataaacttaaaatttcttcttttgcattatcgctgtaagcatgttcacttattagtgaaattattttattaaattctaaagctttaaaagttttatcattcatttctatcttcttcttttaccttttttataaactttttttgtaattgggcgtcttttttgaggtttatttttttttgcgattttaatttttttaccttttgaattataagcaggtcttggtcttacactttgtgagccataggcttttatttcattttgaagtcttcttcttcttgttttttttcttttttctattctcttttttgttctgtgttttgaagaaataacaagagccataacaataagacaagctaaagctataaatataagcgcatttgtaataaatatatcaaaagctgacctcatgtttacgtcacttttagaaaatgcaggaacacttttaaaaagtttattattgaaataaacgttaatatttcctatattgtcatcctcatgtatggaatttacaagttctaattcctctcctgctgttttcttcaaataatcttcatttggtgaaaattctattctaaaattttcctctgttgaatttttatttgaataaacataaatatcatcattgactttaacttttaactcacctgtttctccaagagccaggttttgcaccgtgtatttataaagcgttttatctttttcttctattaaaagtttttttgtttccgtattaccatattttaaaagatctttcgcatatgtaaactgttcttttgtagaagatgcatgaagtacggcggcatagtattttacaccttgtgcattttcactggaaacaattacgcatcttccggcctgagatgtatatccggttttatccccttttgcgagactgtaaaaataatcgctggatttaactattatataattatgccctgaccacctatgagttgttttattggtagttgtttcataatatgtagaattaacaactctattataaaaatcgttattatcagcatatgcagcaactaaagccatatcatgagcagtagaataatgattgctatcgtgaaaaccatgaggattagtaaaatgagtatcattcattccaagttcttttgcttttttattcattgcatcaacaaaaatatcataagctttcttttttgttgttttctctccgttaataacattaccaacattacacgcaagaacgattgcggcatcattaccggaaggaatcattaaaccgtatagcaaatcttcatatgataagacttcaccttttattaaatcagatacagagctaccggcaggaagccaatcaagttcgcttcctacggtaacttcttcatctaaattttttacataatccaaagtaacagccgctgtcataattttggtagtgctggctgggtacatttttttatttccattataattatatagttcactttgggttgaatcttcatataaatacagccctaaactcgaacttttttttacggtaggcgcagctgcatttatacttgaactaaaattaaatattaatataaaagtcattaaaaagcttaaaataactctttttaatcttcttttgttttgcatattgcatcctttcgattattagtctaaaacagtgttatttcattatcaaataagtctttacactcatttatttttgctttatttccggcaacacacttaaccgaatttttaattacctcgtcaaacattttagcatgtttaattaaatcttcttttttagtcgttaatacttcttttcttcttttctttatatcttcgtaagtatccaatgtatatactcttgaaacgtactctcttatttttccatatactgttaaaggaatatccatatcagatattgttccaattataagtttatttacatcttcatcggttaaatcaagattatttatacattcaaaaagatttttatatacatcataggttctttttacatttggatctctatatgaaactagtcctaaattaccatatttatcaatttgaataaatgaaccgtatgctccgcccataactcttacattattccataaatattcagtcgataaatatttctttaatacaagcattgaaccttcatattcataacctaaatttttatataaatacccttgccctacataattaacaagtgaaggcattataatagaagtattttctttgttttcttcatagtcaaatttaattaatgtttcagatgaactttcatatttattaatgaattctttagctttttgaatacttgtttgtttatcttctttgcttacagttataattaacaacgttataagaaaagttatttttctcgttttctttccccttatacattgcatcattttcataaactttccattcatcaatatcaagtttatctataaatgatattatatccttcttatcagatattgtttttactttatcatttgttttaatatcaataatatggatatcttctatactataaagaacttctttatagtcaattacatttgcacttgatgaatcaatattaaaagaataacaaaggataattataaacaccaaaacaaaaaacaaactaattatttttttcatatctttccctctatcaatgtatattttaataataccataatattaaatttttcaatagactttatttcttttttaatttaatatgatataattttttataacgaggtatgaaatgagcgataaaataagaggaaaaatagacaggataatttatcataatcccgataatttatacacaatagctgatgttgattgtaacggtatacttgtaaccatagtaggttattttgaaaatattaaaccagggcttgacattgaagcaagtggagaatatacaaaccacattaaatacggagaacaatttaaagtcgaaagtatagaaatcataataccaactgatacagactcaatatataattatcttgcaagtggaatgttaaatggaatcggacctaaaaaagcaaaagatatcgtagaacattttggtgaagaaaccatggatatattggaaaatgaccctattcgattatgcgaagtaaaaggaatcggaaagaaaacagcattaattgtaggaatagaatataaaaatcagtcaaatatgcgtgatgtaataatgaagcttgcaaaatacaatataaaaccaaactatgcaagaaagctttatagtgagtacaaatcagatactttagctataatacaaacaaatccgtatgcacttattgacgatgtttacggaataggttttaaaagagcagatcaaatagcaatgagtgtaggaatagaacttgaaagcccttacagagttataagcggaataaaatatgttttaaacaattgttatcaagatggaaatacatatattttaaaagatgatttagaagaaaaaacagccagaatgctcggagtcgataaggatatagtagatcatcatttaaaaacactatttctcgacgacagcgtaataatggaaacaatagataacgaagaaagatgttttataaagcagctttatgaaagtgaatgcgaatgtgcaaaaaatcttatgtacataaacagctttgaagatataaataaacaagaaattgactttgatagattgattgaaggctatgaaaaaaacaataagattaaattagataaaaaccagattgaagctgtaaaaacttctataacttcaaaaatttcaatcattacaggtggacccggaacaggaaaaacaacaataattaatgctattatttatatacttggaagtattgggaaaaaatatactttaactgccccaacaggaagagcagcaaaaagaatgagtgaatccaccaaaagtgaagcaaaaacaatacatagacttcttgaatatgaatacacaccacaggaagaacattttttatcctttggtaaaaacgaagataatcaaatagacagtgattatataataatcgacgaaatgagcatggttgacataacggtttttgatgctttcttaaaagcagtaaaacccaagacatctctgctttttgtgggagatatagaccagcttccatcagtaggcgccggaaacgtacttgcagatttaataaactgcgatatattccctgtaataaaattaaacacaatttatagacaagataaagaaagtcttatcgtaaccaatgcacatagaataaacaaaggacagcttcctgtattaaacaaagaagcaaaagatttttattttattaatacaatatctcaagaaaaaattaaaagaaatatattaaatataatatacaactataaaaatacacctttgaaaaattatgatttgttaaaagattttcaaatcatatcccctctaaaaaaaggacttgcaggagttaacgaacttaataaatccgtccaacaattattaaatccggaacataaagaaaaaaacgaattaaattttggacttaccctttttagagaaaatgacagagtaatgcagataaaaaacaattaccaaatgaaatggacagatattaacactcttaaaaaaggtgaaggtgtctttaacggagatatgggaataatcaaaaaaatagataaagagaaacaaactcttgaaatagtatttgatgaagaaaagagagtaacatatcaaaaagatcaaatagatgaactaacactatcttatgctataacggtacacaaaagtcaaggaagcgaatttaaggcagtaataattcctattttcggaggatacagcggatttttaaacagaaatttactttatacggcaattacaagagcaaaagaaatggtgatattaatcggagaagtaaatgcacttaaaagcatgattaaaagtgcttataaaaataaaagaaaaacaatgttaaaagaaagactcaacgaatatttataaaaggaattttaaatggatattttaaatattttaaaagaatcttataatagatttttttatcctaaaacaccaaaatgcagcgtatgcaatagaatatttttaaacgaaaataaaatattctgcgaaaaatgcaataataaaattgaatggataaaaggaaaaagatgtgaaatttgttcgagagaactctcccctatttcatattcaaatttatgtaaaagctgcgaagaagaagacaattattttacgcaaggcttttcaatatggaattatgataaatattcaaaaagaataataaaaaaaattaaatatggagggtgcgaaggtctttgcttagaacttggaaacctattatatgaaaaaacagatgaagtggattttctatatgaaatagactttattattccaactccatcagacaaagaacgatttaaacaaagaggatataatcaagcaaagcttattgcaaaaggcttttcagaaagttcaaatattccaatgaaatcaaatattgtagttaagtcaaaagcaacaaaagatcaaattggtttaaatgaaaaacaaagaaaagaaaatttaaaaggagcttttgaagtaacaaacaaagatgaaataaaagataaaaacatattaataattgatgatgttttaacaacttcatctacaataaacgagataagtaaagtactaaaagaaaacaaagcaaaaaacgtttattttctaaccgtttgttccaaaaaaaatatcaattaaaacaattaaaaagtagaaaatttatgaaaacgtgttataatgttaatatactaataaaagaaacaataaaaaagtttttttatccaaacaatacaaaatgttgtatttgcggtaaaatactattaaaagaagacaatatatattgcatatactgtaatgataaattagagtggattaaagataacaacagatgcgaaaaatgctctaaaaaaatatatgaaaaaggaatttgtagtaattgcaaaaacgaaaattattcttttaaaaaaggatatagtttatggaattacggaaaatattcaaaaaaaataataagtaaaattaagaacgaaaaacataaaggtttgtgcattagtcttggtaatattttatatgaaaaaaccaagcacttagattttttaaaagaagtagatttgatactacctgtgccaattcacacatcaaaattaaaaaaacgtggttttaatcaagcttatcttattgcaaaaggctttaaagacaatacagataaagagttaagggatgatataattataaaaacattatctacaaaagaacaaaaaaatctaagtaaaaccaagcgcaaaacaaatttatggggtgcttttaaaataaagaaagaaaatgaaataaaaaacaagaaaattctaatagttgatgacgtttttacaacaggaagcaccataaatttgttaagtgaaatattattatcagcaggtgcaaaagaagtttattttttaactcttgcaaccactgaaagcattaattaaagaaacgaggtaaagatcatgagaactgacattaaatttaaaaattataatggtgattatgctttaattgaaaaagaagcggaaaagaagcttgacagattaagcaaatatttccctaaagatcctaaagcaatcattatgattagcgaagtaagaggccttgttacaactgaaatcacacttacagttgattcaacatttttaagagttgaagtatcagacagagacgttagaaacggaattgataaagccattgaaaaacttgaagctcaaataaagaaaaacaaagataaacttaaaaagaaattaacggactcaataagatatgaagaagaggaggaagaaatcgaacaagataattcaaagatcgttagaagcaaaaaatttgcaataaaacctatgcttccagaagaagcagcattgcaaatggaattacttgatcatgtattttttgtattcctaaatgcaacaactgattccgttaatgtaatatataaaagaaaagacggtcaatatggcttaatagagcctgaattttagactaaattgttaaaaactattgaattttcattaaaaaaaatgttaaaatgtagtgtctacggttttacccttagacactactataatattgtatgaaatataaacgttttataaatatttttttaagaaaaaactttagcttttacagttaagaaaggaattaattatgtttttacttgaaatcgcgattatctccataatagtgggactgataagaaaaggtagtataaaaaacttttttgtgggaggacttagaggttggtacatttttttagtatcaataattttattcatgtcacaaaaagttttggcattggctggagttacagctttaaatgattatgctttttggataacaatagtagcatacatacttttatttatcgggctattcttgaatctagaaggaatatgggtttatgcacttttaattggggcattaatgaattttgtaattatagttttaaacggaggtttaatgcctgtaagtgaatcagcattaaatattgccctaggagatgccgcagcaacgtacactgcaaattttgccgcaacaatgtccgttgcaactgattcaacaatttttctatggaaatatttaggtgcaattattccgttaccattaccttcaatttttgcggaagtattaactcctggaacaattatcatggcaatttcgtcatttggtttcattcaaagtattatgacaacagaatatatggatgaagacgaatatgaacaatacatgaaagagttaagcagtgaagacaaaaaagatgctccattacttgatgaagcaaaagaagaaaaatatgatgatgaaccagcagataatgaaatagattatacatctatggatagtgatgacatttttgataatgaagctaacgataatgatgttgaagatactaccgaaaacgtaagtctagatgaagagttagaagaattatcaaatgaagaaccggaagaagaaacagactattttgcagacttcgatttagaagatttaagagatgatgaagaagaaactaatgaagatgatttatcagaaattgaagaagaaggcgcaaaattagaagacgaagatttattaaaagaacttgaagacgagtttaatgccggtgaagaagaattatttgctgaagatgactctttagattctcttatagatgatgcattatcagaagatgaacttgataatgaacaagaagaagaacctgaagaagttgaagaagtaaccgaagaaattgaagttgatgatgatgaaaatgatttagatattcctcttgaagccgcagcattggcagcaaatgaagatacaaatgacaataaagattctgaccttgaagacttattaacagaagccttaggcgatgatgaagaagatgaagaaattcaagaattattaaatgaacttagaagtctttcagaagatgatacaacagctgaaaatgacattaaacaaaacgaagaatcgttagatatcgcagaagatgaaaacgaagaagaaaataatgaagaaattgattatgatttctttaaagacgaagatgaaaatgataatgaaatagaagaagtaacaaatgaagatctttctcaaactgttgaatatgaagaagatgaagaacaaaaagacatgttaagtgatgaagatgaggaagtatctacagaagaacctatcgttgcatcaagaaataatattcaagatgcaaaagacttcttaaataaagtaggaaaacaaaaacaagaaaaaacagctgatcctgtaaatccaatgcctgatgtagatgtagacagtccattcataataacagatggaagaatagttgaaaatccttattataaatttaaaaaaggaacaactacaagaagagaagaagcagtgtcttcacctcaaatagatgataacggaatttacgttatgagttctggagaattagcaaaagtaaaaggcggaaaagttcaacctaaaattccaccaaaagacgaaacaaaaacacaagtaaaaaagactaatatcccaaacatgacttatactcctggctttgataaagaagaagaaaaaccacaaaaagaacaatatactcctataacaacaaagctggaaaaagacgaagaaagaaaatcttcaaagattcctactaatgattattcttcaagaatacctatggataatccttacgataataaacaagaaaaacaaacaagaccaaaaagacaatatagaagatattctccaacatcagaacaattggaaagagaacctaatatgacaatcataaatgactcttcaacaggaagaacaataaaaagagactcaagatatccaagagaagaagttcttccaacatataaagactcagtcattgatgaaaatggaaaagaagttccaaatccatatgaaaaagtagaaatgaaaattggagatgtggaaataaaattttggaaaaaagataatcaataaaaaatagccacggtattcccgtggttatttttataaggagaagaaaatgcgattttataaaaacgaacttcttataggaaaagaaaacgtcgaaatgttaaagagcaaaaacgttcttttaattggatgcggaggcgttggaggttactgcgcagaagcattaataagaagtggaatatataatataacaatagttgacaatgacaaagtagatataacgaatttaaacaggcaaattatagctttagaatctacaataggtaaatataaagttgatgtactaaaacagcgtataatggatataaaccccaatgcaaacgtaattaaattaaagacttttattaataaagaaaatattcctcaaattgtaaacaatgaatttgattatgttattgatgcaattgattcaatgacaagtaagattgatttaatagaatattgttataaaaataatattaaaattatctcttcaatgggaatgggaaacagactttcccctgaaaatattgtaattacagatatttttaaaactaagtattgcccaatggctaaaataataagaaaagaactaaggaaaagaaatataaaaaaacttacagtatgctattcaaaaaatgaagttaataaaaaatatcaaacgccatcaagtatgatgtttgcaccaagtgtttgcggtataacaatggcttataaagttataaatgattttattaatgataataatgcggaggaataaaaatggcaattgaatttaaaaatgactggcaggatttattaaaagacgaatttcaaaaagactattataaagaaataagaaaaaaacttgtttatgagtacaaacattataaaatttatcctgatatgtttgacatattcaatgcacttcactatacatcatatgaagatacaaaaatatgtattataggacaagatccataccatggagtaggacaagcacatggtttgtctttttcagtcagaaaaggtgtagctcctcccccttccctacttaacatatttaaagaacttgaagatgatcttggaataaagcgtccgacaacaggatgtttagaaccatgggcaagacaaggagttcttcttttaaatgcagtattaacggtacgtgcaaaccatgcagcaagccacagaaatctaggctgggaagaatttacagataaaataatatctttactaaacgaaagagaaaaacctcttgtatttattctttggggaaactttgcaatttccaaaaagaaacttataacaaatcctaatcatttaatactaacaagccatcacccaagccctttatctgcttcaagaggatttttcggaagccatcctttttcaaaagcaaataaatttcttatggaacatggtcaaacacctatagatttttcattagaataacaaaaaagcctttacaaattaatttattagaagtatattatactaagactaatttttagggagataaaaatggtaaaaggtataaaagaaattttcagctggggattaacaatattaattgcaattattcttgcacttgtaataagaacatttatatttgaacctgtaatggttaaacaaacaagcatgtatccaacgttaaatgattcggataaagttattgcaagtaagatttcttatattatttctgatcctcagttccaagatatagcagtagtaaaaattgatgaaaacaatgattatgtaaaaagagttataggacttccgggagatactgttgaaattaaaaattctaaagtttatgttaacggagaacaaatatatgaaccttacatttcagaagatttggtttacgatgattatcctctaacaacagtacctgaaggaaaatattttgttcttggagataatagaccaaactcaaaagacagcaggtctgcagaaataggttttattccaagagaaaattttaaatcaaaaatagtatttagaattttacctttctcggactttggaaaggttgaataaaaaaaaagagcttttattaagctcttttttattttattgtcatatcttccccaggatttgtaaagaaatctgttggaggaagttctctttcatattttttaaatactctaaatgtattatataaccaattacctttatcaagatttttatctggtaaatgaacaattattacccttcttggattaagtctgtttattatttctcttcctgcttttaaagcaatataagggaaaggagcaattaaaacatcaacatctttttcaaaaattccagcttctttaaaattctcaacaacaggtgcactatccccaagatgcataaaagtctttccaccaaattcaaaataataagcaaagttttctacatcttcataatttttaccgtcatgaggtaaagaaataacttcaaatgatacattcttgatacttgctaaaattgatttgaaaaaaggaatttcaaattcgtgcacttgagaaactataataggatcaaaatttgcactttcctttaatctttccataacagtacaagtacaaataagttgtgttaatctgttattttttaaaatctcacatacacaagaagcatcaaaatgttcaatatgatgatgagtaaaaactaaaatatctattttatcatatggagcaactccatctataattttttgcattgtttcttttttaacgctaaaataaggtggtacaggtttaatatgaactccatcaattaaaatctttttacctttattttcaaacaatactcccgcgttagctatatattctatggttacatttttcttattaaatgccatcaatacactcctaaattatttatttaattgtatttattatacattgttttttactcattctcaagttaatataatttgtttttaataataaacaaattttaatctaatatatttgtattattatttaataaaatatgattatatattataattaaaatatattttaattcaaagagggaaaatatgaagttagatgaaaataaaattgaaatgttaagagatgctactggcagagattacggtttttgcgaaaaggctttaatacgttcaagaaataattatgaaaaggctttagagtatattataaattatgatgaaagatatataataagactatataaacatattgtatcaataagttttggagaaaaaagttatcgttttaaaattaattatatgaatgaaaatataatggatataccattacttctacctatattaatttgtattattgttccaataccttcaatttttataggtcttttcttagtatttataatgataacaaattcatcaatcacaatggatttagtaaatagtgaagatgttattattccttataaacgaaataaaataaaaaagaaaacaaataaaaatataaataatgtaaatacatacgttaatcatacaaaaatttcaaaagatgaagatggattcaatattattgatataatgtaaccaggaggaaaaaatgaacgaaatattacttatagaagacgaattaaaaatcgcacgttttttacaattggaactgacacatgagggatataacttaacaatagctacagaaggaagagacgggcttattaaagctatggacgataaattcgacctaattatacttgatttaatgcttcctaatttaagcggaatagagatttgcagaagactaagatcaaataacattcaaacacctataataatgcttacagcaaaatcagatgtttcagataaagttatggggcttgatataggtgcagacgattatatgactaaaccttttgcaatagaagaacttctcgcaagaataagaaaaattttatcaagatcaaaacgagaaaatgaaaaaaaagaaaaagaagcaataattaaagccggtaaaatagttttaaacaaaaatacttattcagcacattttgacaatgaagaaatatcccttacaaaaaaagaatttgaacttttagaatatcttatgataaataaaaatatagttctaacaagagagcaaatcgttagtaatgtatggggatatgattatgaatcagaaacaaatgttacagatgtatatataagatatttaagaagtaaaattgatcaaaaatacaacacacattatattagaacagtaagaggaataggctatcaatttaaagatgatgatgaagaatagtaaaaaagagaaaaaaagaaggagaaaaaatagtcagagcataaagcaaaaaacggctctatggtatacatacctttatttggtaattgccgtagtagctgttattgtgctgtctatttctcttttacaatcaacatatgatgaagcatataatgaaagcagtaaaattaataataccgttacaaaaattttaaaaaacggaagatttgaagataaaaattatataatagaaaatattgaaaacatagaaaaaaaatacaaacaatcaataatatcaattataaatacaaacggagattattatcttttagaaaaaaatgataatatagaaacatatattaaagatttaaaatataattatttatttgaagccttcccaagaatatcattattaaataaaggatatttggttagttcaagagatattaagacagataacggaatatataaacttcttattttttattccgccaaaccttttatagaaagattaacaacagtaattcctcctgtttctattgttctatgttttggtgcacttattattcttattcttggaagaatgaaactaggaaaaactttagctccaataaaccaaatgaacagaacaacaagaaaaataaccgcagaaaatctagatttaagacttgatgtatcagaagcagaatatgaacttaaagaacttgccaaaacaacaaacgaaatgatagattcattccaggatgcatacgaaaaacaagaaagattcgtttctgatgtttctcacgaacttagaactcctatttcagttatttccggatatggtaacatgttaaaacgctggggtaaaaaagatgaagaaattttagacgaaagtgttgattctatcatttttgaagctgaaaatatgaaaaatcttgttaacagattattatttttagcaaaatatgataaaaagaaaataaactataattttgataaagtaaatttaacagacagtgtaaatctaattataaaagattttacaataacccatcctgatattacatttataaataatatagataaaaatatatatataaatgctgatgagtttaggataatagaagtaattagaataataatagataatgcaataaaatattcaaataataatgttacattaaaaatcaatttacaaagtaaagacaataatgctatactatctattaaggataatggaatgggcataaaagaagaagatttaaaaaatatttttgatagattctacagaacagataaatcaagaaataaagaaacaggcggaatgggacttggacttagtattgcaaaatccattattctggaccataaaggtaaaataagagttaggactaaagaaaatgtcggtagtgaatttataataacattacctttattagaagaataaaaaggagacataatatgataaacatgaaacaatggcttgaaacaagaagcaaggaaatatcaagtcaagttgttgaaatcaatcaaaaagaacttacagatgaaggcatcagcggctttggcatgaaattaaaagttaacgaaatcataaagaatcttgaagcaggactcttccctaccatatatgaaaaagatttggataataatgaatttataaacatatatgttagaaaaagattaaatactgctgcaatggagcttaacagtataataagagaagtctacataaacatgtgtgacaatgaaaataaaaataaaaattgtacaaaatgtaaagaaaaagctgatgaagcaaccattaagtttatggaaagcataccaaaggtaagagagtatttatcaacagacattgtagctgcttataacggagatcctgctgctatgagcattgaagaaatacttttaagctatccttaccttgaagcaattacaatacaacgacttgcacatgagctatttaacttaaaggtacctctaattccaagaataatgacagaatatgcacatacaaaaacaggaattgatattcatccaggagcacaaataggaaaatatttctttatagaccatgcaacgggagttgttataggagaaacttgcgttataggcaataatgtaaaactttatcaaggagttactcttggagcaaaaagttttgaacttgatgaaaatggtaaccctgtaaaaggagttaaacgtcatccaaatattgaagataacgtaattatatatgccggagcaactattcttggaggcagtactacagttggtgaaggctctataatcggaggtaatgtttggttgacaacaagtgtacctaagaattcaagagtatataacaatacacctgataatttaatagaagttgcaaaataagacttgtatattttacaagtcttttttatttaaaaatcataaaattttctttttgggaaaaaataaaatagaaaatttctaaaaaggagtgaaaaagatgaataagctatttttattattagttatcattggtgctataaactgggggcttatcggcttttttcaatttgatttggttggagcattatttggtggtcaatcatcaatagtaagcagaataatctttgctttagttggaataagcggattatattctctaagtttctttaataaagtagataataatatggactaattatttatatgtaaagctgacataacgtcagcttttattttacataaatattgacaaaaaaataaatcctatttaatattatatataaataaattaaggacgtgaaaaaatgccaagacctacaaaatgcaaaaatgtttgcaaaatgcctatatcaaatacttttatatcacaaaacaataatagcgaaacaacaactttgacagtagaagaatatgaagtaataagacttatggacaacgaaaatttttcacaagaacaatgtgcaaaatggatgaatgtttcaagagcaactattcaaatattatatacaaatgccagaaaaaaaattgctaactttttaacaaaaggtggaaagctaattattgatggcggtaattataaaatatgtgattgtaacagcgaagaatgcaactgtacaaattgtaactgccataaaaaataaaagagcatataaaatgctctttttaagcttcccaagataatttttttcctgctaataaatggaaatgtaagtgatgaacactttgacctccatcttcaccgcagttatttataattctaaatcctttttcatcaaagccctgatctttcgcaatttttttacatactgcaaaaatatgattaattatcttatcttcgtcatcaacatctaaaatagatgaataatgttttttgggaactaccaaagcatgaaaaggtgcaataggttcgatatctttaaatacatatacaagttcatcttcataaactttagttgaaggaatttcacctgctattattttacaaaaaagacaatcactcattttattaccccctatttttgtcttacaataatatcttgtccatctaaacagttttctcctgttcttaacaagtttgcaattacttccgcaacatcttcaggttgcattattgttgttggatcttcttctggagctaaaatccttctaagctcagtagcacatcttccaggagaaatacaataaactttaattttataatctctaagttcatcagctaatgttttagaaagagatattactccggcttttgcagctgcataagccacccaaccaggtcttgaagtagatcctgctgttgaagctatatttaaaattttagcgtctttacctttcatatatctcacacatgctctaatcattacaagcatagaaacagtattgattgtaaatgttctttcgaaattatcatttgtcgtatcaagtaaagctgtaggatttacaaaaccagctccatttataagtaagtctatagaaccaaattgtttataaatttcatcgacttttttatcaattccatccaaatccatcatatcattaggtaaaaccataacattacatttaggattcatcatttcttttgttttatttaaattatcaacatttcttgccattaagacaatgttatctataccttcttcattactcatttttatagctgtagctctacctataccttgacttgctccagtaataatacatgttttcattttatattattcctttcctactataaattctttatatatctgttcacatgttaccaaatcaacaggcgtagttatttttatattgtataaagaacctggtaaaactttaatttttttatcaggattataatgatagaataaagatgcatcttctgtaaaaaataattcttcttctcttgctttttcgtgagcttcaagtaataattttaattcaaatttatgtggaagctgaacatttacaagctcatctcttaccaaattttcagatataaaattatctttttgttttaaaactgtaaaagggatatctagtccataaattgcattatcattttcatcattaattaattcttcatattcctttttacttacaaaaggtcttaccgcttcatgaacaataacactgtctacatcttcaagatatttacatcctatatatgttgattcctgtctacttttaccaccttcaacacataaaatatttttttgaatgttgtggttaaaaattaatctttgcatttcttcaatatgttctttaggcgaacaaataacaaccttttctatttcttcaattttttcaattttttcaagcacatgaagaataataggttttcctccaagtaataaaaactgtttgggtacaggtctccccattcttttacctataccaccggctaaaatgatcattcctgttgacattttaactcctccttaaaagtataattttattttataatattaggtttaattaattcatttacaaatctttcactggctttaccatcagcaacttcaaatgtttgatttttaaaatcttttactttatccatttcaaaattaccattttttatatccattgccatagatatggtatcagtataaacttttcctggaagatctttatgaaaatctatataaaaacctctttcatcaatataatcatagtaatcacttgcaaaaaacatcataggtctttcaagtaaagaatattcaaatattgcagatgaataatctgtaatcattatatcacttatcatcattaattcatttatatcaggataatcgcttacatcaaacaagaaaccttttaaatcatcattaatcttatatttttccgttatccatggatgaagttttaataatataatatatttttcacctatattttctttcataacagaaaaatctaaatcatctttaaaatatgcatctgttttatgttcacctctaaatgtaggcgcatataatataatttttttatcttttggaagattatacatattacatactttttcaggtagcatactttttaattcttcgttaaaaaaaacatctgttctaggtataccaatattagtaacaaatttatccattcccacattaaaagcttcagcataaaattttgcattatactgactacccatcaagcaataagtataatttgtatgaattgggctgatttcaagatcctttttactaataccaaaatttctatctaaaacactataaccaactttcttaaatccaccacttgcatgccaaacttgtattacaactgttttcttcttggttttaataacatacaaaggaaaataatgggcatctaaaataataaaatttgcagttgccatatgatattctgataacatatttttaagtaaatatttaatctggttttttaaacctttttttcctgcaatattaaacatacatacagtttttaaatttaaattttgcctttttatttcatcataaatatatttaggatttctatccaatttatctgtattattagcaacaaaaacaacctttttttgtataggtaaaatatatgaaatataaaaagatgctcttaataaaaattttgctgttcttctttttaaactttgtcctttggttattgatttttgttcaactttattagacataatgtttattcctctttatataactataatttaaacatattctcaatgaactcgtcagtcaaggttccgttattctttcgttcttcgagtaacaattcatctttcatagtcttatacggtatttcataaacaccatcaccatgataatctttactattaattattaatcttcttatagtagcaaatttaaaatgaagacctgcttcattattccataattcaccagccactctataagttcccggaagtaattttaaatttggtaaaataattctatatacatgtcgtcccattgaagattcaactgtattatctgcattttgcttacttgttgcaaaaataactctgtcttcgatatctctaatagaaaaagaagcaactaaatcattttctatttcttttttaacttcatattcaacttcaaaaaccaaagatgatccatattgaaatctcattctattattcaaatcaacatctgtgtttataaatctcgtttttattacttctaaaatatcttttttttcaaaaatttcattttctttttcctggctttctctttcttgaatcctcttttttgtccttacttcttttaaatagtcctcgtaaagtttcgttaccatatcggtatcacctttagccattagttccccatcttttatccacatagctttcgtacaaaacccacgaatagtaaataaactatgacttacaaaaagaattgttttcccttgttttctaaactcttcaatttttgataaacattttaatttaaaagtatcatcccctactgccaaagcttcatcaactattaatatatcaggttcaacatttacacttattgcaaaaccaagtcttgacttcataccggaagaataagttcttacaggctgatataaatgatctcctatatctgcaaactcaattatatccggaattcttttttccatttcatccaaaggaattccaagagtagttgctttcaaaaatatattttcatatcccgtaagttctttatcgaatcctgatgtaagctctaacaatgctgagattctaccatgaacttctatatttccttttgtgggagtaacaactcctgtaatcatttttagtaaagtagatttaccagaaccatttactccaagtataccaattgtttcacctttcgggaacttgacattaatatcttttaaagcataaaactcaccatatttaactttatctgaaaaagcattaacaactctatgccaagcctttttatatattttatacatctttgtaacattattaacgctaacagcaacattttcatccggaatattatcaggccaatcttttaacatagttgctttcatttcatctgtaatttctatattaacatcaactgaatttcttgtaaatttttttgccataataccctcctataatacatccgaaaactcattatggagttttttgtaaagatatgcagttaacaatgtaaataataaagtaaatactagcatatatatcgtatatgcaggtctttcaaaaaaccatgttttaaataaaaacgtatctctatatccttgtataaaataataaaaaggattaagtttaagtattttaaataataaagacccttctgctaattttgatggtgcccaaacaactggagataaccagaaaaaaatcattgttgttgattttataagttgttcaaagtctctgcttattacagataaagttgataaaaaggtacataacacacaactaaaaaagaataaaaagccggtataatatataatctgaaaataatatatatttggataatatccgcaaataaaaagtactataaatacaagaactaatagtattaaatgcgtaaaaaataacgacattacattatatataggaattgtttctataggaaacacaacctttgtaaccaaataactatctcttctaatagaagaaatacctatatgcataacatcgttaatataaaaccaagctattatacctgccattaaccaaaaaataaaaggaatattaccatccattggttttcctcctcttatgccgatttgaataccaaaccaatatacaaaaataaataatataggttttacaagtgaccaccccacacctaatgctgaccctgaatatctttttttaagggtcattttagccattgccatagatttttttctgtttttaatattcaatttaaatatttcaataaaactaataattgcttcttttaacattattataattcctcacgataaatttattttttaccataatttatctaattataatactataactataaaaaaaagtcaaattgacaataattttaacataaaaaaaagccttataaaaaggctttttttatgtattttattaaccaaaatatctttgaagtaatccttcaaaagctttaccatgtctagcttcatctctagccatttcatgaactgtatcatgaattgcatcaagattagcttctttagctcttttagctaaatcaaatttacctgctgttgcaccattttcagcttcaactctcatttcaaggtttttctttgtgctgtctgttacaacttcacctaataattctgcaaatttagcagcatgttcagcttcttcataagcagctttttcccagtaaagaccgatttctggataaccttctctgtgagcaactcttgccattgcaagatacatacctacttctgaacattctccttcaaagtttgctcttaaatcagcaataatatcttcgcttacacctttagcaacaccaacaacgtgttcagcagcccattctctttctccgctcatttccttaaatttttctgcaggaacatggcattgaggacattctgctggaggattttctccttcatgaacataaccacatactgtacatacccattttttcataattaattatctccttttatatatatttattttattttttatttaaatagttttttaactattataagcttttacatttctacaacaagtctttgattatcatcaaacccgttattttcttttatttcttttaaacttttttctatattgttgcaatgttcttcatcaaagtaatccataatttcatttgtttttgtattatatacatgaatgtgaaactttgtatttgcatcaaaacgcatcatattattttcatcatctctaacttttattatcactccattttcaacaaatgcatctaaaatattataaactgttgcaagagagaatttatttcccaaagaatttaaatgttcttttaccatatcagcacttgggtgttctttacttgacataagatattctaaaactgcaattctatttggagttgcttttaacccatgacttcttatgatttcttttaaatccatatttttaattttctcccctttcttatttaaattggaatgattataatttaattatatatatataatttattttgtcaatactttttttatttttatataatatttttttatatatttaatattaaataactttttatcgttaaaatttattgattttgtatataatgttataaaataattatctatcataaaaaaaacagatatttaaaaaaaagtaaacatctgaatttcaaatatttccctaatacaattttgcatttacacaattgtagtaacaccaaaagttaacaatgtaataataaaaccagcagttaacacccctgcaaaaataggtaagattgcatcttttaatctaatatctaaaaatgcagcaactaaagctcccgtccatgcacctgtaccgggaagaggtatcgcaacaaaaataaaaagtcctaatttttgatatttttttaccttttctccctttaaatgagctttattttcaagtttatctaccatatcatttaatttaggcatatattttctaataaaagaaaaaattcttcttataaacaaaattataaaaggcacaggtataaggtttcctattacggcagcaatatatgcttcaagtaatgaaagccccgatgcaacaccaatgggaagtccacctctaagctctataataggtatcatagatataaacaatgtataaaaaaaacttttcaatttttaccacccaatatattatatttcttataaataatatattatataaaataaaatgtcaattaaataaaagcgatacgttataattattgtaccgctttttatattattttaataatgtagaaggattaatattatctgcaccttgttttacttcaaaatgtaaatgataatcgtcagctatttcaaacgaagaacttttcccaacagttcctataacttcacctttatttattatatctcctttttcaacatttaacttcttatttaaatttgaataaatactgtataaattattcccatggtctatttcaacactataccctagcctttcatcataatatactcttttcacctttccatacaagatactttttacattttcatttttatttgattttaaatcaattcctttatgatcagatatatactcttgtaaagtatttgaatatacaggagttgtattatagctataatccataattatttctgcactttgtactggacgcgaaatatttgataaatctaatttagcagtatttaaaacatcttttgttttttcattttcttcaacgtcaatattttcatcatcttttgtctcttctgttttatcttcattatttatatttaatgattcactgcttttatttttattacttcctttatttaactcttcattcataacggacttttcttctactctatcatcgcccacatcagcaacatttaaattacttttgtttataatacctccaaacattactcctaaaataagcatcacggaaaaagcaacacatatttttgaaagaaacttttctttttgccccattttaattttttttcttattctttttttcaccttataaatcctcccggcatcaatgtctttttatatatttttattattgccaaagaatacttctttaaacattatttattcacttataaaacataaaaaaattcgtttaaaaaaatttcttttaaaatgtaaataagaaaaaatacttttaaaataaggttttttggtgtataattccataagagaacacggaggggtatatatgttagaaaaattaaaatctatagaaaacagatttaatgaagtaaataaagatattataaatcctgaaattatgaataaccacgagttatatacgcagttattaaaagaacattctcatttagaaccaattgttaatgcatataaaaaatatgcaagtgttatggaacagttaagtgaaaataaagaaatgcttaacgaaagcgatgatgatgaattcaaagaaatgattcttgatgatattgcagatttaaacaatcaaaaagatgaacttgaaaaagaaataaagatattactaattccgaaagaccctaacgatgaaaagaacgttatcgttgaaatcagagccggggttggaggagatgaagctgctcttttcgctggagatcttcttagaatgtatacaagatatgcagaaagaaagaattggaaagttgaaatgttatcaactaacgaaatcggtattggaggatataaagaagctgtattctctattcaaggaaaaggtgcttactcaagacttaaatatgaaagcggaacacatagagttcaaagaatacctgacactgaatcaagcggaagaattcacacatcagcaataacagttgcagttttacctgaagctgaagatgttgaagtaaatattgatcaaaatgatttaagaattgacgtttaccgttcaagcggtaacggcggacaaagtgtaaatactactgactctgcagttagaattacacatattccatcaggtatcgttgttgcatgtcaagatgaaaaatcacaacttaaaaacaaagataaggctttaaaaatattaaaagcaagattatttgaaattgaacaaagaaagcaacaagaagcaattgcaagtgacagaaaaagccaaataggaagcggagacagatctgaaagaatcagaacatacaatttccctcaaggcagagttacagatcatagaataggattaacattatataaattaaatgatgtacttgatggagatatagacgaattcatcgacaacttaattgttaaagatcaatcagaacaaatgggaatagaagaataaaaaaagaggactggtaacagtcctcttttttataatttatttaatgctgaatttcttttttcacttataatactataatagttatacatatttcttgcaaccttatcatcccatgttgaacttgaagcatatcttttatttacatcacttatagttttaccattatataaagatgcaccttcttttaaataattatttgcaagtccttttgcaacatcatcaatacattctgcttttgaagaatatccgcttgaaccataaccaaacatattatttggtttaaagcatattgttccgttcgcactttccattgaagcaattgcaacaagaaacaaacaattaactccataatcttcttccgcctttacaaaagcttcttcaagccccacaagattttgttttgttatataacttaattctttagcggttacaccgcttggtttgcttacatccatactgtaaatttcacttaaagaataacttttcagcttttcttctttcttcactttacttactgtatattcacgtaaactatctgcaatatttacttctttggcattagcagcaacattaacagccttttgtttttcaagttcaattgcattatattttatatcattatatttatatacacctataccagtcgttaaaatacaaccacataatactatagctgtaatttttaaaattttctttttttgtttttcctttggaattgctgtctttaattctttttcaacatgttccagttcttcttttatcttttttacatcacttattattacatcattattattttctacttcctttttatcctcattttcatgagaaaattcttcgatagtttcttctattagcttttcggcattttcaaggtctaaaagtgcactttcaaaagatatgtcttcactatcaaaagaagctatatttttatttgtaatttcattaacttcatctttaacttcttttttttcatcttttaaagtatcttttattatacgatgacgcattaaaaattctttttctctcttattcagcctcatcgtttttttcactttaacttttttatttttcatttatatttcctttatataattagaactatttgaagatattttacttcttttataaataaatgtcaaaaatttaattattttattgaaagatacaaattttatatatacaatataactattaaagtgaggtaaaaacatgaaaaaattagtatctcttttattaacattattaattattttaagtcttttcggatgtacttttgtaaaaccggaagaaaaaacagaagaatttttatctgcaataaaatcagggaataaagatattttgatgggatatgcagataatgaatatataaatatgctcgtaaactcttctggagatgaagaaacattaaataaaatatatacgaaccttttcaaaaattttagttataaaattatttctacatcaatagatgaaaaaacagaaaatgcaaatattaaagtagaaataacaaatgtaagttttaaaaatgtactaaaaaattatgaaaaagaatcttatgattatattgtagacaatttatattcttcatcaaaaacaaaaaaatcaaatttaaacaatcaatgcctaaaaattctagcaaatgaaatagaagatgcagcaaaatcaaccaaaacaactacacaaactgtagaaataaaacttacgaaaaatgaaaattacagttatgatctaacgattgacgatacattaatggatgcattgacaggaggcttaataagcagcataaaaaaataaaagacacttttaaagtgtcttttttattattctacttttttaaatttatccggtcctgctccacaaataggacatttataatcttctggaagaggatctccttcataaacatatccacaaatagtacatacgtattttacaccatcatattttttttcttcttctttttcaggtatataagtaggtgcattttttgctgttttacctcttataacttcatgataatatgcatatgtcatttgtctcttagattcatcataaacctcacctgcgataacttttcctaaaaatacagtatgagtgcttgtttccattttatcaattacttcacatacaacataaccggcactatcttttacaacaggaacaccttcaaccatttcataatcaacattttcaaacttatcattgtctttaccacttttaaatccaaaatttccaatcaaatcaggatttgaattttcacttaaaattgaaaatgcaaattttcctgttttttctatacaaccattcgtatagttattatgatttacgctcaaagctattgttgcaggctcagaagtaatttgcataatactgtttactgtacatccagttggtctttcaccatccattgttgaagcaatatatactccataagacatttttctaaaaatatttacgttcattttttcaccttatttcctttattatattttatttatatacattgtttaagtcattgcagcaccgtcaactgatagaacagctccatttatatagctagccatatcacttgctaaaaataggaatgcatttgcgatatcttcagcctcgccaacccttcttaaaggaatagttgcaattaaaggttttataagttcttctggtaatgctgctaccatatctgtattaataatacctggagcaacagcatttactctgatattatctttgccaagctctctagccaaagattttgtaagtccattaatagcagattttgatgcaggataaccaacaccagatggttgtccatatatgcttaccatagaactagtatttaatataacgccacctccttgttctttcatgattttagcaacttctttagatgcattaaatgctgctgtaagattcaaattaataattttctcaaaatcttccaaactataatcataaatactatttcttgcagacattcctgcattatttactaaaatatcaattttgccaaatttactctttatttctgaaaaagcttctctaatttctttttcacttgttaaatttggatacatcccaataacatcataacttttattttcctcatttagttttgctaatgctttattaaccgtttcttctcttgaaccaaataacacaactttagctccatttttcaaaaatgtttttacagtagcaaaacctattcctcttgttccccctgtaactactgccactttattttttaacatatctattcacctcctaaataacaaatctatattaacgtatatttgtatttaatttaattgtttacataagtatactctctttaaaataaaaagtcaagtaaattagaacaattctaatttaatttgcattatatattctaaatatatttacattaaaatgtatatccgtatttcagattgattaagtaaatgtttataagaatcaaagatatacccaataatttattaaatataaaattataataaatttatatacttattttaattaaataaaaaaataaacatttttttataaacagcttatagttaaatacacataaaacaaatgcttatttaataataccctattattaagctgaaatattacttaaataaaataaacttttaaaacatattatccataaaactaagacatacatttataagtttaactgacatcgatttacctttaaaaactcttaaagatattatgggatacagtaaaacaatgaacacagttaaaacttatggccatacattagacgtagaaatggaaaaagcaaatcaaattataaataacaaatttactgaaatattagaaaataagtttaattaaaataccgcacttttgaccgcacttttaaccagacatttaaccacacttttaaatatttgaatagatattttagatattttaaatatttatataaataaaaaaaaggcttaaacccctttaaaataacgtatttgaatattttaaaaatttatgtaaacaaaaaaaactgaaaactctttataacaaagtgttttcagattaaaagcaaatggcggagaaggagggatttgaaccctcgcgccgcttgcgcgacctatacccttagcaggggcacctcttcggccaacttgagtacttctccgaattctatataaaaaaaaagatattaaactcttaatggccgagagggtgggattcgaacccacgtgggcttgcaccctaacggttttcaagaccgccccgttatgaccacttcggtacctctcggttttcatcaagcttaattatattatcatatggataatactttgtcaatatcttttttaatcttttttaatctttttattttttattactcatttctaaagttttatttatacttgcaagtaatgcatctattacaacccctctgaaaccagctttttcaagaacatttacaccttttatagtcgttccccccggagaacaaacattatcttttaatgcacctgggtgttccccgctttctaaaaccatctttgctgaaccaagaaccatttgtgcagcaagcttatatgctaaatctctcttaactccgctttcaacagcagcgtctgccaaagcttcaatatacatatatgtataagcaggaccacatccgcttaaacttccggctgtatcaattagtgcttcttcaactatttcactcttaccaaaactattaaatatttttactacattttctacatcctcatttgtagcttttttattagctgttattagtcccattccttctccaacaagtgcaggagtatttggcatggttcttattattcttagttccctaccaaacatatcttctatattttctattgtctgccctgctgcaattgttacaataagtttattttcatcaacaacatcttttatttcatctataacagttttataaacatttggtttaactgctaaaaagataatatctgttttttttgcaacatctttattatctttgcttgtatttacaccatatttttctttaaccaaatttattgtcttatcagaaactgcagtggtatatatattatctttacttacaagcttactatcaatcatacctccaataatagcttgagccatatttccgctgcctataaatccaatttttacattcataactatctcctttttatattaaaaaccatttatttgaataattaaaatttttctttaaataatttgaatattctttataatttggacaaaccttgtaaagaagttcataaaatcttttttgatgattcatttgttttatatgacaaatctcatgatataaaacactttttataatttctatatcatatttcattaaagcaagatttaaacatattgaatttgttttctttgaataacttccaaacctgctttgttaatgatacaaatatacccataaatgttattatttttttgtattttgtgttcataaagttgctcctttctttcttatattacgttttttagatacatatttttataacgatgcatttttatatatactattattacataaaaataacgtttttgtttataaaaaatgtaaaaatttggtatttatattattttatgcaataaaaaaacaaagttttgaggctttgttttaatttaaataataatgtatattattattgtcaatataagaatctaaagtttatgttatattttttatttcctttattaattagtttttttatcttgtaagaaataatataaagtagaatataactattactagaacaattcctttaattattaattttattttatttttcatatttactcccttatttgtcaataaaaactattttatatttatttaagtcatatacatttccaaaaaaactttttagcatagtttctgcattttttcttgcgttatcatatagaccgttttgtattgcttgtgtttgtgcttcactttgtaattttttcagtgcttggttattttcgcttaaggtaattttattaaatatgctttcttcttcatggtagactttgaaagaatctaaatctatttcgctggataaaattttaacctcaggtaattttacttctattgtatctcccttaatattccattgtatctggctaaaatcgtatcctgcttttattgtaatgttatagctgtatatgtatttactttgagtaaaaggaattttatttccaaataattctcttgaggaatctgtcacgtttatttgtgtacaatatgcagattgtgttgcaaattctccaatattttcaaatcctatttttgttgttttgctatctgtaataaaagtatcttttattcctattgctataaagccggatgcaatagcaacgataattagtattataattttttgcattaatggattttttaatatttttaaaagtttattatttttcttttcttttttattattcttttccataaataaaaattctccgtgttaatttctataaacattatacaataaaagttatatttttttacataaattgacaaggaatagcttatgtaattttataggatatggtttaaaccatatcctatttttttaatttgtttcattttcgttttttagattttctatatcttctttaaaactttgtaacttttcatttgctctttccatatcttcttcccatatttcattacctatatctatataaagattatctatatcactttttaaatctaaccattcatcatatatatctgaacttgtatctgaccacatatcatattcttttgatgccatatgataccatttttcatatgatactttgtcataggcatcttctaacactccatcataatatgtatcatacatattttttaaaactccattatcaatttcttcatatacgtcatcagctgcatcttcatatataatttcatataactgttcaagtttttcgtatttttcatcacttgataaatttgaattgacgatactttgagtgtaagaaaggctgttttctctaagtcttatatttaattgtttttgtgtgttagatatgtttatgtaaaattcttgtactttttctctgtttttactgtattttccatatgtatttatttcattctttaaagtctcaaagtcgttgtttagctttgtaatagtatcgttaatatcattattcactttttcttttagttcttcagaggtatctattttttcaacccaatttaaattgcttgaatttgtagtgttagatatttgagtattacagcccgttaatgttaatattaataataatattagtatgtatacaatatattttacctttttcataattatttctcctttacttcttttatcattgtatcttttagatttaaaatatattccttatatgatatgggaaggggaatattgggaagaattggaaagttatttgagtttatccattctataaattttatttccttttttaattcttttatttcttttttcatttcctcctttctttttttgaggtaagcattttgcttatttggggtgaggattagtatttcctttatttctttaatttcaaaattcatttcttttaatattaatattttccatatttgctctaaatcttttttttgatataaacggtgattatcttttgttctatgaagatttgttaagccttcattatcatagtactgtaatgtccgaatacttactcccgcaattttacttacttcttttatttttttcattaaagttctcctttccccgtatccctagcatactgtatgacgttttcgtcatagcaataccctaattacggttgtaattaatatttgttcataaaagagcttgtaaaattcgcgaggaaagtttatgcataaaagagcttgtaaaattcgcgaggaaagtttgttcataaaagggtttgtaaaattcgcgagaaagtttgtccataaaatgaattgtaaaattcgcgtgatagtttaaattattttttataaaggtgtaaaaaatgcaaaaaaaaaagagataacttttgttatctctttttaaaaggagaggtttgattattgatatttctttttaattgcggttgttagaactgttattgaaaaaccgcttacaatcattaataatacataaggcatactttttgtatcaaatcaatttatttaaattattaaacttatttgtctgattttttttattttatatattaatcattacaaatatgaactatgtattaattataacattattatcacaaaatgtattatttttgtaatttttattatacatattttcatatctaaaaagaatttcaaaattttatttcataagacatttaaagaaaagacaatccaaaatatcaataaaataataggaggaaagtaaaaaaatatgaagaaattacttggatttgtattatcaataatgatgttaataagtatgttacccactgttacagcagcagaacaaaaaaatattacttcacctgaagtaacacataaagctacaaatttagatagtaattatatttcagaagtaacaatgactgttcctgctgaagaatatagacagacaatggatattgtgttcgtattagatggttcaaccagcagcgatgcttctgatttagcaaatgatgcagccaatatgttaaataatctaacaaagatatctaatattgacgtaaatgcaggattagtaatatttggcggaagtaatccaattttgtattcaagtgatagtatggaaaatattagtgatgagagtgttctcaataatttaatggaaaaaatgaccgataaaagttacaatggacaaactggacgttcaggaagtaatcttcaagccggtatagaaaaagcacgttcattactaaaatctggtgttgcagaatcggataataagtatcttgttttgcttacagacggcggtgcacgtatgtgggttaatgataatggacaagctttggcacaactaccatatctgaacaactggaataccaatgaagattttatagcacgttatataaatggaaagcttaaccttagaacttttggagaaataattaatgatgcaaactcaggaaaagatataggtaaatattcaattacagaagataaaaaatcagataaaaattatctcgttagtaatttagaacctggaatggatgtaaatacatctatggattattattcaaatttagagtctgcaacttattttgccggtcagtcaataattgaaatgaaagaaaataatgaagctaatgttatatgggtagattatccatataataaaggaacaaaatttggtgattatacagagtctttcaagtcctggatggctgataaaggttatgttactcgttatgatagtgatagtatttcagacccatttgctgaagttaatgatacattaatatattatatgggaaaaggttcaaaagtagaaaatattattggttatggcagtgataattatggtaactcatatgactttgatatggttaaccttgataacttaaaactaactattggaacgaagactttaacaacaacaaagattagcgataataaatatgcttttggacaaaaagataatgatggaaattatccatttgaattaatctattatccaaatggaaaaaatgataatggtaaagatagttttgatcttttaattaatacaaatgtaaaaatggatgattttgtaaaattacattataatgtaaaactaacaaatccacagacaattaatggtacatatggggtttatgatgaagacggcagtgaatctttggatgcattaaaagtaagtaaagaagccacattatatcctatcaattcacaaggagaagaggaggattctgttccattttctcttccaacggtttcttatactgtagataataaatcacagactgtttctgtgaatattgcatcaatgacagtttatacaggcggaaaaggctatgaaggtgttgtaatggatcagcaaggatatgtagcagcatctaataaaaacactcttccagaacctggatatactattgatttaccggaaaatgttgataaatggcttaaagaacagcttggtgtaagtgatgatacgacattggatatttcaaaatatttgacatttacctataatgacggaaaagaaactcgtaaatggagtattgaaaaatatgatcaacataaaggaaacagcagccaggtaaatggacgttacctatatcgcttagtttcttctaaggggcaagatccaattcgtcttgagttccgagatgaagatggaaatataatgattagtgatgattttacagttgaccaggatactccgaataaaacttatactatgtctatttatgcaggggcattaaatcagggattagttaaagctgaaattaaacttccaaattcagattcaagttacagctttgatataaatgttgttagtgctgaacttaaaattagaggtgtagtatctgatgaagaaaatcctactactgaaattgttacgggagaagaaccgaaagaagccgtaagtgaagtaacagcacaggtacctagtgaaactaaatattattataaaggttcagataatcaggtttcgagtatcgaagttgcagattcgagtgcagtgaacctccttgttgatgatgttattccaagtgcaacttctactttggaagaagcatcattagaagaatttgatgtacttcctgataattataatattgaaatgaaatatcttgatttggtatatacaaataattcaaatgctgtagttggtgcaaatgaacctattacaatttactggccttatcctgaaggaacggatgaaaatactgaattctttattgttcattataaaggtttagaccgtaatgataatgaagctttaaccgataattatgaaatggaactgttcagtgaaaatcaaaaaaatgaaaaatataagttaacaaatactgataatggaattcaaattactgtggattcattctctccttttgctttaatttgggaagatacaagcgcatcaggtacaaaaacagataatacatcatcttcaaattcgtcttctttaaatacaccaaatactgaagataaaaatatggttggagcatggatattactgtttgcagtttctttcacggcagtgacagtatgtgttagaaaagaaaaagtaaataaataagttttaatattattaataaaaatagtaccgtagttttatttatcggtactatttttattttatagaaaaataaaaattatattaatttaaatatagaaaaaataagaatcattgcttaatttacattgtcatttttaatttttttattttttcttgtatctgttttatttcttcatcgtttaactcgcttaaatgctccagcttatccataaatacagttatggtatattcttcccttctttgaattacttctaaataatggctcactatgacccctgaaagcatagctatcattaaagcttgatatagagtaatatataccgttaaaagtttgcttattgttgttgtaacaacaatatccccaaaacctattgtcgatgaagacacaaaagtataccataaagcatctccatatgatgataccccaggttcttttatcattattataaatgctaccataaaaatacttaaaataaatcctatggttatcttttcaccgttacatcttcttactatagaccaaaaaagtcttgcttttttcatatataaaacctcttttttatatatcataacataaaataaaaaaagaagagaaatctcttcttttttataataataaaatataaataattattcaaaacctttgtctatatcattaaataattcatcgttaaagaagtctcttatgcttatttcaaaaaaatcacataagattttaattgtctttattcccgggtttttacattttccatcgaacatactgtaaagagtagtaggaggaatacctgccatgtttgcaagtgaatttatggaatatccgctttcttcacatagcgtcattatttttttatttatagcttctctaagttgcattttattcacctccatttattaatattacataaattaaatttagccaaaatcaaatttcttttcttatattttacatgattttattaaatataaaaagtaacctatggcgactttatgttgacttttttaaaaaaatattataatataaggtaaacaatcttcagggttgggtgaaattccctaccggcagttatagtctgcgagcgaaagctgaaaaggtgaaattcctttaccgacggtaaagtccggatgagagaggatacataaagtattttttttagtaatttcctgaagggcgattactatttttttatgtataccttaaattttaaggaggtataaaaaaaatgaaagacactagaagacttgtaacagtttcaatgcttattgcattgtcaatcgtattaatgcttttagtacgattcccaattatgccatcggctgcatggcttgaatacgaaccaatggatgttccacttcttattataggtttaatgttcggacctgtaacaggaataatatccgttataatttcaagttgtatacaagcactaacagtaagtgctatgaatggttgggtaggtgcattaatgcacataatctcaagcagcgcacttgtaggtgttgcaggatttgtatacagcaaaaacaaaacaagaaaaggtgctgtattagggcttgttcttggagctttagcaatggttcttgttatgattccggcaaacttggttattacaactaatttctacggtatgccattagaagccgtaaaagcttcacttcctgttgcggtaataccttttaatattttaaaagccggtattaactgtataataacttttattgtatataaacctatcagtaactttataaaaacaagacctgatagtgcaagagtaaatacaacaaaatagaaataataataaaatctttacttaatgaatccatttagcctctcaaaacgagaggctttaatttttttcatataaaaaagccccttataaaggggcattcgttcttaataattattctgcttcttcggctagctcttttagtttatcctcataagcttccaaaactttgttttgcatttcgactcttgtttcaaggtttatcggatgtgcaatatctttgaattcaccattaggcatttttctactaggcatagcaataaataccccattgtctccttcaattattttgatgtcatgaattacgaattgatcatcaaaagtaacagatacgatcgctttcatctttccttcgtcatatgtctttcttaccctaatgtctgtgatttgcatttgtctttcctccctttattctgttaaatatattatacattataaatttaagaattgcaataacgattacatacctatgaataaaggatttcataatttttcaacatgatgtttttactttaaatatttgccgatttttttaatataattataatataaataaatattgtaaaaatcattgaaagatagtaaaatatattaagtatataataagcatataatgaaataaataagtgttaaagtttatataaaaacaatacggcggtgaaaaaatgaatatagatttagaaaatataaaaaagatatattttattggaataggcggaaccagtatgtctggtcttgctttaatgtcaaaaataaacggtaaagaagttttaggttcagatatgagaccttgtgtttataccgaaaaattagaaaagaacggaattaaagttattataggacataataaagaaaatataaccgacgatatagatttaatagtttattctgctgcaatcagagaaaataatcctgaaagagttgagggaaaaaataaaggtattcttgaaatagaacgttcaattttccttggacttataagtaaatattataaaaaaaccgtagctgtaagcggaactcatggaaaaacaacaacatcttcccttatgtctttggtatttttaaatgcaaatcttgatccttcaatttcaataggaggaactttaagaaaaataaacggaaactcaagagttggggacagcgactattttgtaatagaagcatgtgaattcgtagacagtttccttcattcaagacattttgtaggaacaatacaaaatattgaaagagatcatcttgattactttacaggtggtatagaacaaataaaagaatcatttaaaaagtttgcaaaaattactccaaaagacggtttacttgttgtaaacggagatgataaaaacgttcttgatattttagacggacttgaatgtaaaatagttaaagttggtctttcagaaaataatgactttgttgctaaaaatataacatataacgaacttggaaaaccaagatttgatgtatataaaaacggtgaattttattatcactttgaacttaatataccgggagaacacaacgtacttaatgctttaagcgttgttgcagtttcagatttctttatgattgacaaaaaaattgtaaatgacagttttaaagaatttatgggtgcaaaaagaagatttgaaaaaagaggagttgtaaacaatattactgtaatagaagattatgctcatcatccaacagaacttaaagttactattgatgcttgtaaaaattatgaacataaaaaattattcgtaatattccaacctcatacttattcaagaacattccttttatttgatgagtttgtagatgcaatgaaaggtgcagacgagcttatattaaacgatatttactcagacagagaagataacgaatggaatatatattctgaagacatagccgaaaaagtagttgaaaaatacggcataccttcaagagtaataagtgaattttcagatataagagattatattgtagaaaatgctaagccgggggattttgttcttgttgccggaagccaatcaataaatcaagttgcttacgatatagttgataaattaaaagaaatatatgaataaaaaagaccgagatttctcggtcttttataatatatagcaaagaatcggaattgtgataaaggaacatacggttgttataaatactccttttgatgcaagagcagcgtttccttcatatttacctgcaaacattacggttatgtttccaacaggcattgccattactattatggtaagccctaaaattaatggatttgtaataacatgttttaaaataaacattgcagctaatggaattaatatttgttttattattgtataaggatataatttatattcgttaaatatttcttttacaggaattcttgctaatgaacagcctattaaaatcattgcaagaggacttgttatactccctaccatttcaaaagttgagcttaagaaagagggaatatttatagaaaatataaaaataattattgcaagaacgcttgatatcattcccgggtttatgacttttttgaaatcaaattttgttttttctttactatccatattaaatagataaattccgaggctgtaaacaaatatgccgaataccatattaaaaaggctacatagaaatacggcactttctccgaatattgtttttgttacgggatatcccataaatccaatattagaaaatattgtcataaacatataaagtccgaaattttctttttctatttttaatattttatttaataatattgctataaaaggaagtattaaatacattaaaaaagcaataagtaaaataagaaaaacagtgcttttattatatgatatttcaccagttgttacggatgataggatcaaacacggggttgttacatttaaaatcagtatatttaacttacttgatacatgtttatccatataccctattttttctaagatatatcctaaagtcattaccaaaaacaaaacaatcatttgtgttattatattgcttaaatccattatgctcctttctttttaccacattaaactgcttagtatttcaaattctttttgagaataagtttcttttttctctttgtaagggaaatttttttcaaattctataaagtcattttcgtttatattaaaatcttcactttcaacaaatctaaaatcttttacatcactaagataatctttttcaagttctaaagccaaaagaggaacggcgtttttaccatcttcggtttttatatcaaattttaaagcaagggtaaaaccgaacctatggtataaaagaggatttccatatattataattgctttatatcccatttcttttgctttttttattgaataatttattaaatcactgcctattcctttgtgtttatattcaggtattatgctaacaggaccaaaagtaagtacatctttatgtttattttcttttattaatttagcatttgaatatcctatatgccctattaattgttcatcttttttaactacaaaagaaagctcttttatataatcatcgcttttatgaagtttattaagcacataatgttctacacatccttttgtataaacattaaaaaatgcttcccttgttaaaaattcagtatttttataatcttctttggtttcttttctaataatataatctttattcatatttattctccttttatatttaatttaaaaattgatactaataaaggacactaaaataaagataacaaagttatctttattaaatatacaaatatattacattaccggtaacaaaaagacaccacctttatttttataaatttaacacctatataataacatatttacaggtataaatttaaaataataaaatttaaaaaataaatattttattattattatattgtattaaaaaactaattttggtataatcttgtgatattacaataaatttttattttttacttatttttctatatattttggcaaataagaaagttatttgttttattgttattttcatttggaggtgtgatatggaaagtatcaataccgctaatcctcttgggtatgaaaaaattccaaaactcttaaaaggttttgcaattccaagtataatagcgatgattgttagttctctttataacattgttgaccaaattttcataggtcaaggtgttggttatctgggtaatgccgcaacgaacgttgcatatcctttaacaactatctgccttgcaatagctcttttaataggagtcggaggagcttcaagattttctcttcgtcttggtgcaggagaaaaagaaaaggccgcaaaagttgttggtagtgcaatttcaatgatgtttgttttcggtatactttatgcatttttaattgaaatatttttagttattttgcttaaagcttttggtgctacaacacaagtaatgccttatgccatatcttatacaagaataactgctcttggtatgccgcttcttgttgtaataaatggtatgagcaatcttgcaagagcagatggaagtcctaaatattcaatgatgtgtatgcttgcaggtgctattgtaaacacaattttagaccctatattcatttttgtatttaatatgggagttgcaggtgcggcaattgctacagtaataggccaagtattctcttttgttatggcaatattatatataaaaaatttcaagcacgtacatttaacaagagattgttttgggcttcattttaaagaatgcgttaaaattgcttctcttggtatgagtaacagtttaaaccaagtggcgattacttttgtacaaatagttttaaataattcccttacattttacggtgcgagatcaatatatggaatggaaattcctcttgctgcctgcggtatagtaatgaaaacaaacgcaattttacttgcagtaatcataggaatttctcaaggaactcaacctatagtaggttttaattatggggcagaaaaatacgacagagtaataagcgtttataaacttgcaatactttgtaatcttgtagtatcttttataggttttatagcctttcaatttttcccaaatcaaattatttcaatattcggttcgggagatgccctttactatgaatttgcggttaagtttatgagaacatttttatttatggttgtattaaatggtgttcagcttatatcatcaaatttctttgctgctataggaaaacctataaaagggcttatattatcaatgacaagacaggtaatattccttattcctttaataataattcttcctttattctttggacttaacggtatactttttgctgctcccgttgcggattttattgcttttataacaacaactgcagttgtatctaaagaattaaaaataataaagaataaggaaattaaacttagtacaaattaaaaagaaagacttttatgtctttcttttttatatgattgattattatatttttataataatattttactgtttaaaattatttctttttatattatttcttttaaaatatcttctacttctttttttgataatacttttccttgtgatacaacttgttcatttataacaagggcaggtgtagacattacgccgtaatttgaaatttcaacaaagtctttaacatgtaaaacattcatatctatgttaagttcttctaaagcttttaaaacattattttcaagattaatacagttcttacatccagagcctaatattttaatttgcccatttgttttttcttcattattatcattattttcacatttacaagtactgcatccacatgatttttttaatattttcatttttctctcctttaatttttatattaaaaatccttgcatatagttaaatatatagcctattaaaataattccaaaagtacaaattgatataaacaatataagaagttttggtttaacggcttttttaagcattattattgaaggtaggcttagtgttgtaactgccatcataaaagaaagaattgttccaagaagtgctccttttgataaaagtgcttctgctattggaattgttccgaatatatctgcatacataggtactcctaccaaagttgcaagaattacaccaaaaggattgtcgcttccaagtatgccggttattatatcttcaggtatccagttatgaattattgcccctattccaacacctattaatatataaggaaatactttcttaaatgtagatgtcatttgattttttgcaaacattattctttgttttttcgagcggttaggaatttttacgttgatgctttttgcatttttaataaaatcttcaacgtattcttccatgtgcattttttcaattatgcttcctccaataactgcaagaataagtcctataattacataaaaaattgcaactttataaccgaaaatgctcataagcaaaaccaaacttccaaggtctaccattggagatgatattaaaaaagaaaatgtaactccaagaggaagtcctgctgatgtaaagcccataaataaaggtattgaagagcatgagcagaaaggagtaacggttccaagtaaggcagaaattatatttgctcttattcccttaaattttccgagtatttttttacttctttcaggtgggaaatagctttgaatgtatgaaataataaaaattaaagtacaaagtagtatagttatttttataacgtcataaataaaaaactgaaggcttccacccattcttccatttaaattaattccaaaaagaataagaaagtttcctattaatgaatttaaccatttcattgaaagaatttgattttgaataaataataatactgactgaatcatattaattctccttataattttttcatatcaaaaaattttgatatgttgcttaaaataaaagtcatcttttagatgactatttacagcaattcgtagtgttttcattttccattgttatttctctaagtctttttattgcatgttcacttcctagtttacttaatttgtaatgtgtccatttaccatcttgtctgctttgaacaatgcctgattcacataatattttcatatgatatgaaagagaagactgccctatatccattttatctattaaaacacaagcacatttctctccgttttttaataaatctattatttttaatcttttttcatcgcataatgctttaaaaatttttacatcttttgaatagtcttccatattattacctcatatcaaaatattttgatatgagtataatataattttttttatatactgtcaatagatatatcaattttttttgatatgtatatattattttatgtttaattaaggataaaaagtataaaatttctaaaattagaaaaaatatatatgaaaatattataaaggagatagtaatgaaagcgacaggtattgtaagaagaattgacgatttgggtagagttgtaataccgaaagaaataagaagaactttaagaataagagaaggagatcctttggaaatatatacagataacagcggagaagtaatactaaaaaaatattccatggtaggagaactctcaagctttgctcaggaatatgtagacagtctatttttaagtgcaaaaataacaagcgtaatttgtgacagagaaaatatagttgcagcttcaacgggagacaaaaaagagcttatggataaaaaaataagcaaagatttagataagataatttcaaaaagacagcttgttacttctttaaacggagaagtggatatagtaaaggacaaaaaaaacgaacataaatatgaagttatctcccctattgttgcaaacggagatccaataggagccatagtacttttaagtaaagacaaaaatatttccgttgaacaggcaagtctgcttgcaaaaacaggttcaatatttttaggaaaacaaatggagcaataaaaaagaacactactgtgttctttttttattttttctcgcttaaaaacagtcccgataaaaccagtattgttcctataatcataacaggagttataggttcgtttattattataaacgaggcaataattgttattaccggtgtaatataaatgtaagcactggtttttaccgtccccaagatttttattgatatattccaagttacaaagcaaagtgcacaggcacaaagtcctaaaaataaaatattaaatattaatactttagaattaaataacgttaaatcaaaggtaaaatcaaaaaacggaagcattaatatcataaatatcagtccgtaaaaaaacattcttctggttgaagcaatcatattgtatccaaaagttgatatttttctgcttaaaagagaataaaaagcccatattaaagctgcaataatagcaagtatatctcctataggatatacttttactccgctcatatctttaatgcttattaaaataattccggtcattgctataataaagccgtaaaaaaagtttttatttagtttttcttttaatataatccaagaaagcattcccgtaaaaaacggagctatggaaacaagaacacctatgtttgaagcattggaataagtaagggccatgttttccaaaagataatataagcttactcccgtaagacctgcaaagataaaatatatttcttcttttctatccttaagttttagtttttttggatacataagaaataaaaataataaacctaaagtaaatctatagaataaaatttccataggggtaaaagttcttaaaagtattttggttgatacaaatgttgtcgaccatatcattattgtaaatattgcaagaagatgtcctaattttttattattttccattgttaaagcctttctttatttatgcgtttaatattctacattaatttatttcttatttcaatttaataatttaatataatgtttcatgtttttatttatgtgttaatattgttatataaatatttaaggagataattatggatatttttgaagttttatatgaaaaaaggaatgaagaaaattccgttaaaatggctaagtatatgaaaaataaatttgactttctaggtattcccagaagtgaattgaaaaaaatagaaaagatttattttaaggaaataaaaagtcaggaatatattgactatgattttgtaaacaagtgttacgaagatgctcacagagaatttcaatatctatccatagattatttgataaacaagaaaaaatttttaacaaaagaagacattcctttcataaaaaatcttatagttacaaaatcatggtgggatacaagtgattcattatataagcttatggcatatctttcattaaacgatgaggatataaatgaaattcttataagctggagcaaggataataatatatggctcagaagagtaagcataattcatcagcttttaaggaaagaaaagacaaataccgagcttttggaaacaataatagtaaacaatcttaaaaataatgagttttttataaataaagcaataggatgggctttgagagattattcaaagactaataaggaatgggtaagtaactttatcaataaatacgaagataaaatggcaaatttaagcattaaagaagcaagcaaatatttataattttaatctgactttaattttaaaaaagtagcataaataataaaaaagaaaggagaaaattatgagaattcttgttgtcgaagacgaaaaaaaccttaataatttgatcgttaaaaggttaaaagcagaaaaatatagtgtggatagttgttttgacggcgaagacgctgtttattacattgaaaataccgattatgatgttgtgattttagatattatgataccaaaaattaacggttttgatgttataagaagaataagagataagggaattgaaacttatataatagcactaaccgcaatggattctacggaagaaatagtaacggggcttaatcttggggcagatgattatatggtaaaacctttttctttttctgaacttattgcaaggatttatgcagtaaccagaagaaatacaaaaaacaaaaccaatgtttataaagtagcggatttggaagttgattgtaacagtaaaaccgtaaaaagagcaggaaaagagattgagctttcttcaagagaatatggaatactcgtatttcttataaaaaacaaaggaatgattttatcaagagaacaaattgagcaaaatgtttggaattatgagtacgagggtgcttcaaatatggttgatgtatatataagatacttaaggaaaaaaatggatacaggatatgaaaagaaacttattcatacaaaaagaaatataggatatgttttaaaggaagaataatgagaaatttatcactaaagactaaacttaatttttggtatatatttgtaatagcccttatacttatttttactttggcatttttatccgtaagtatggacggatttaccaatgttacattaaaacagactctgcaaaatgaaattaatgaatgtgttcaggaaataaatgaagaaggctatgatgaaatttttgacgatgattttgaattttacaaagatggagtagaaatagcaatatatagaaataatgagcttcttagaggtaatgttccttcagatataaatggagtttcatttaatgatggcgtaaatgaatatgacggagagtccaataactggtatgtatatgataagatgaccaatattgacggagtgtttgtaagaggatatatgtcaatttctacactccagacattaaacacttttttaatgacaatatttatagtattaataccgataattcttattgtttcatcagtggttggatattttataacaaaaaggactttatcacctattgataaaattgttgaaacggcggttaacatttcaaacggagatgatttatcaaaaagaataaatttaaaaacaaaatcaaaaaatgaaataagcataatggcagatacttttgatgcaatgtttgaaaggcttgaaagatcatttgaaaatgaaaaaaaattcacttctgatgcttctcacgagcttagaacacctgtttccgtaatacttgcatcttgtgattatgccttatatgaaggaagcgaaaaagagcaaagagaagccttgaaacttataaaagaacagggcgaaaaactttcttctttaatatctcagcttcttatgtttacaagatttgattttaacagaataaaaatacaaagagaaaaaatcaatttaaatgaacttattgaaagcgttttggaagaaatggaaataaaggcagaggataaaaacataaagttaaatatggatataaaagaagatataaatatatattcagatactgtacttataatgagggtatttataaaccttgtatctaatgccataaaatacggaaaagaaaacgggtatgttaatataaatgcatatgaaacagataaagaagtaatatgcacagttgaagataacggaattggaataagcagtgaaaatatagataaaatctggaatagattttatcaggttaatccttcaagagataatgaaaacagccttggacttggtttatcaatggtaaaaaccataatagaaaaaatgggcggtaaaataactgttacaagcaaagaaaatgttggaactacttttaaaataattttaaaaaaataaattctttaattttactttaatttttctttcctatcatttaggtagaaaaaagaaaagaacgaaaaaaatggaggaaagaaagatgagaaaaagaacagttttaattatggtaacaatagtaggtattgctttagtaggtgcaagtgtatttgcaaaagatttaggtatgaattatatggaaaatccatttgaacaaccaagtacaaattctacaaacttagcagatgaaaatacatcattaatagaagtaagttcagttaaacaagatgatgacaataaaaatataatagacgttcattttacaacaaaagttatgtgggataataatgcaagtataacttcacttacagatgccggcggtaacagttatagtgcaaagattattgataaggatgatgacgatttagaaatttatgttgaaggaattaaagacggaacaaattatacagctgacattcaaggcataaaagcgtataatgataattcttatacaaatttaaaagtaacttttgaaactgaaaaaacaaaagaaacatctaataactcaaaatcaagcttaaaagttaaggaagttgactttgacagagaagataaagaagtatcattcgactttgataaaaatattaaattaaaatcaggtgcttatgtaatcattaaagattcaaacggcaatgcttattcaagtaaaaattcaagaatcatatgcgacgaagacgatattgaattgttccttgacaaaaacttaaaacaaggtcaaaaatacacatatgaaataaatggtataaaagaaaacgtaggtaattcttatgaaacaataaacggtagctttactgcttatgatgattaatttaacattgtaaattaaatataaacaaataataaaaacctcatgtagtttactatatggggtttttatttattaaaattctaattggcaatattgaaaaagttaaaaaaagatatataatataatcaaacataattatgaatacaaataaatattatttcataatactgggaggtgtatgaaatgaaatatttaactgtaaaagaagttgcacaaaattggaatgtttcaacaagggtagtgcaaagatattgtttagaaggaaaaatcgaaggagcaaaaaaggtttccaatgtatggcaaattccacaaaatgcttccaatcccattaataatggaagaacaaaacaggaagtaatagatacatcaaatcttatgcctttattgaatactccttttaagccaggtgaatgtttgaaatatattaataatattaaaaaaggagattcgagggatattgctttatgcgaatattattatttcagcggacaagctgaaaaagccgcaaaaatggcagaattatatctaacaagctccgatttatctttaagactttctgcttatcttatttattcatatgcaaatctttccttaggtaatataacacaagcgaaatatgctctttccatgcttaaaaaaatagcttcaagtaaaaaagatattccactattaaaagatgcaagtgcatttattgccacggcagcagcgattttattacatcttcctcttccaaatgaaataccgccaatgaaagaatatattaattttcttcctgaagggcttagaatgtttgcgctatatgttcatgctcattatagatatttacagggagaatatgaaagaagcataggtatagtcgaaactgctattgcattgcaaaaagaaacatatcctatttcttctatatatttacatttagttgcggttatggattatatgagcataaaaaatgtaaaaaaagcacaaaaacatcttcttgccgcttgggatttggcacgtcctgatgatttaatcgaagcttttggggaacatcatggacttcttggaggaatgcttgaggctgtaataaagaaagactggcctgatgattttaaaagaataatagatattacttatcgtttttcagaaggatggagaaaagtacataatccgataacaggaagagatgttgcggataatttaaccactacggaatttgcggctgcaatgcttgctgcaagagggtggacaaatcaagagataggagaacatatgaatatatctgccaataccgtaaaacagtatatgtcttccgcttttcaaaagcttggaataaatcaacgtcaagatttaaaaaaatatatgttggattaaaaaaactctgcatttagcagagtttttattttatattattgcatctacaaaatcatcaacatcaaattcttctaaatcttcaagtccttctccaagacccacataccacataggcggtttatcttctccggctaatgaaactattaccccgccttttgcgcttccgtcaagttttgtcattattataccatcaaccttggcactttcattaaagctttgtgcttgaattacactgttttgtcctgctcccgcatctaaaacaagaactgtatataaattataatcgcctttgaatttatcgcagactctgtaaattttgttaagttcatccattaaattctttttgttttgaagtcttcctgcgctgtctgcaagaattatatccatattttttgcttttgcagaatcaaggcagtcataaattacacttgccggatcttgcccttgtttactttttacgattggaacgtttagtctttctgcccaagttgcaagctgttcgcttgctgctgctctgaaagtatctgctgccgctaaaattacttttttatcctcttttaagaatttatttgcaagttttgctattgttgttgtttttcccgcaccgtttactccaatgaaaagtattaaagcgggttttttaatttctttatcccaaagatttaattttagtctgtttttaatttcttctttaattaaatcatgtagtttgtttatgtcttttacatcttttttagtggcattttcctttacgttttcgattatttcttcgcttacattgaaaggaatatcgcttaaaataagtacttcaattaactcttcatataaatcatcatctattttgtttgatgaaaatacatcttttaactttgatagtaaacttttttttgttttatcaagtcctttattatatttatcttttgacatttatttcaccgccttcatgtatatcttttaattttacgcttacgatttttgttattccttcacttcccatggttgctccgtaaagtacgtcggctatgctcatggttatttttctgtgagttacaacaataaattggttgtctttaattattgattttaaatatttgcagaatcttgcaacatttgcatcatcaagcgctgcgtcgatttcgtcaagaacacagaatggtgcaggttttaatttaagtattgcaaatattaaagctattgcagtcatggatttttctcctccggatagagaagaaatatttttaagttttgtttttggaggagaagcgacaatatctattccgctttccattatatcatcgggatttgttaaaataagtttagcgtttcctccgttgaataactgcttgaatacttcttcaaactctttgtttatgttgttaaattctcttaaaaatctttcttcgattttagagttcatatcttttattatgtgtagaagttctccttttgaatcttcaaggtcatctttttgttcacttaaaaattcaaatctttcttttacttctttatattcttctatggattcaacattgatgtttcccagtttttttatgcttgcttttaagtcttttactgttgtttcagtttcaagcatattttcaataggctttttatattcgagtgcttgtgcgtatgtcaggttataatcttctattattcctttttgaagataatccatttcaagatttgttttgtcttttttattttcaagcttttgtatttgctcgcttaaacgatatctttcttcttgaagattttttaagttgtggttaacttcttcaaactcttcatttgattgttttttcttttctattaaagaagcatatttgtcgtctaagtttttctttagttcatcataatctttatcaagctctttagccttatttatttcttcgtttaataaagaaatattttcttcgttttcttcaatttcttttaaactttctgatgtgttaagttcaatattttgaatgtttttgttaagctcaaaaatagctgtatttattctatttaatttttcttcttgtttataaagattaatttcttctttatttagttttgttgccatatcaagatatttatctttatataaaccaagacctatctttgatatttcatctttcttttcttcaatttctttatttaattgctcaatttcttcttttgattgttcgttcataagaaggattttttcatctgaagtctttaagttttctattcttttcttgttttcttcaaatgtttttattttcttttcaagattttcttcagcttctctgttcttgtcttcttccttgctaataataagagtaagttcgtttatttcatcagcttttaactttaactgttcgtctttttctttaagtttaatatcaaaagaaccgctttgttttaagtattcgttataatcttttaccgcttcttttatttgtttgtttagtttttcaatttcgttttttcttgataaaagtgaacgatcattgtttttattttgtccacctaccaaagctcctcccgggaataaaacttctccgtcaagagttgctattttatatttatgtgcgcttttttttgcaaagtcatttgcattttttagattatcaaatataagaagtgtgccaagagcatttttaacgatattttcaaacttcttatcatattttacaatatcgcttgcaacaccctcaaatccttttgcatttgttattacagagtttaagttatatatttctcttggttttattatgttatgaggtaggaatgttattcttccccacttgttttcttttaaagctttaattgctcttgcagctgtgctttcatctttaactacaacgtgttcaacggtagatgtaagggatttttgtattgcatccatatatttatcgggtacggaaataagatcccctaaagtgccgtacacttcgtcagaaaggcttgtgctttttgcaaattcaaaaagttttttgattgcgaatttataaccttccttgttttcttcatatcccgttaaaatgtctctttgtccttttagaagttttactttgttgtatttttcaagaagattttctttataatcagctttcgcttcttctattaaatatctttcttctaaaagcttattgttttcatcgtcgagtttttcaagtttttcttcgtttttaaggttatttgaagtaaagtcctgtttttcaagttcttctatttcaatttgtaattctttgttttcttcttcaagttttgtaatgatgaatttattgttttcgattctgttaaagctgtctgcaagaaggctttctttatcttttagtaatctttcttttgtcttaagatttatgttttctttttcaattgcactttctgtttcgtctgaaagtccttttaatctttcgacttcttgttttaacttagaaaattcttcttgtaattttgtaaataattcttcttgtttttctttattttccttattttcatttaaagataagactgcttgttctttttcttcttctagttttaatattccgtcttttaaggattttatattttctgtgtgagttaatattttatttttgtttacttcaacttcaactttagaattttcgtaatttgaaatgaagtcgtgtatttctttatttgcgttgtttatttcttcatcaaaagaatttacttcaagttttaatttagagtatttttcatccaaaacagagatactctcttcttgttttgttaaagtatctctcattattttttcgtcttcttctatttttgaaagttcttctttgtatttatctgctttatgaacgaataaattaagctctattcccttaagttcatcgcttaattttatatattctcttgcctttttggaatttctttttaaagtaggaattcttttttcaagttctgaaattatgtctaaaattctgtatagattattttgtgttttatcaagctttttaattgcttcgttttttctgcttttatatttaactatccctacggcttcttcaatcattaattttctttctaccgcagagttgtttacaatgctttctattttaccttgagaaattattgagtatccttctctagatagacccgtatccatgaaaagttcttgaatgtctttaagtcttacggagtttttatttatgtaatactcactttctcccgaacgataaagtcttcttgatacatttacttcgctgtattcacttggtaaaatccccgaagagttgtctattgttatgcttacaaaagcgtaaccaagagctcttttttcttcagttccggaaaagatgacatcttccatctttcctcctcttagggatttaactctttgctcccctaaaacccatcttattgcatctacaatattgctttttccgcttccgtttggacctactattcccgttacgggattatcaaataaaatctcgactttctgtccaaaggatttaaagccgtatatttcaactttttttaaatacatttgttaccgcctaaattaattttaatttttttagtgtagcaaaagcagcgtgttgttcgctttcttttttgttttttccgtccccttcacccatgtccttgttgtttattacaacttttgaagtaaacacttgatcgtgttccggaccttttatttgaactaattcataagaaaagtcttttatgttttttgagtgaatatattcttgaagcaaggttttataatcataagtaagttttccgtcaattgccttttttgttatgtcagaaagaaggttaagagcaattttgcttactgtttcgtagtcgctgtctaaatatattgctccaagcaccgcttcaaagcagtctgcaatgatgtttttcttatatttgcctccgcttatcatttctccttttccaagaagaataaattctccaaggtctagtttttcgcttgcaatatataaagaatccgcacatacgattaatgctctaagttttgtaagaacgccttctttatctttttttagtgtattataaagatatgctcccacgcataaatcaagcacagcgtctcccaaaaactcaagtcgttcgttgttttcgagatttttgttttcattgctttttgatgaatgtgtaagagcaactttaattaaatctttattgttaaaagtataaccaagtttttgttccaatttataaattttattttccattttctccctcgtaaaccatgtaaaaaattacagaagtttcctttaattttttaaatagtttaaggctcctttacggagcccttttttatttttatagtgattctaaataatcaacaacatctttaactgttttcatatcttcaagtttatcttcttctatttcgataccgaattcatcctcgaagtcagctattaattcgatcaatgttaaagagtcaacgtccaaatcatcagtaaaagaagtatccattgtaacggcttcttcacttacttctaactgctttacaataatgtctctgactttttcaaaaatcatttacaataaacctccatacatttacttaatattatatatatacttatatcatatattttctatttagcatagatattttttattttttctaaaacttcgttttcttcaaattttatggcttgtttaattgcgtttttaaaagctatttcatctgagtttccatgagcttttattattcctccgttcactccaagaaggggagcaccgccgtattttttagatgaaagaccgcttaattcttcgtttaaaacgctttttgcaagaacataacttatttttgtttttgtatttgttaaaaatacatcttttagtatgtccttcattaaatttcccataccttcaattgtttttaatataatatttcccgtaaaaccatcacatactataacgtcgttatcgctattcattatttcagttccttcaacgttacctacaaaattaatttctttgttgttttttaatatttgatgtatttccttatatagtttatcgcctttttcttcttctgagcctatgtttgcaagagcaactttagggtttttaactcccattacgttttccatataaatgcttgacattgttgcgaattgttctatatagtcgctgttacaatctgcatttgcaccgcagtccattaaaagtacaggtttctttcttgcaggtaacactgcaccaagggcaggtctttttattccttttattcttcctgttactaaaactcccgcagataaaacagcacctgtgcttcctgctgtaactaagacactgttacggtcttctttgatcttgtttgctgcaacaacaagtgaagattgtttctttcttcttatggcaagtgcgctttcatcatgacatgtaatttcttcaggagcatggataatacttattttatccatacttaagttgttgtcttcaaatactttttttattttttcttcgtgtcctaccaaagttatttctctatcaaattcttttacggcaagtacggcaccttttaccattgcatcaggtgcataatctccgccaaaagcatctacgtatatcatatttttatacctctttttttataattatattctataaattatatcataaattttttttcttttctatattgtgagtatgcattaataatgtatatttatgcatgatggaaataaggtgtgttttataggtgttattaaggttatcaagttttccacaacttatcaacagattgtaaaaaagtagcatataaccaccggtttttatatatatgaggtatattaaatatcttcttagttatttatattcttcctctgtatttattatttaaaggaacaaaaaatccttttataataggtatttcgacaatttaatgaatacaaaaagtaagctatcggactacaaaaaatcagttatataactacaaaaagtaagtttttattataaaaatattctttttaaaaaatctttaagtaagctataaagatacaaaaagtaaggcttttaaatacaaaaagtaagtaggcatttttcgtaaaaaagcccttaaaaaagctattttaagttgaaaaacatagaaatatatgtttcccgttaagtctagtctgtttactattccattaaacaagtcattaaagggtattaaattaatgcttcttgaaaaatatctattataagaaaaaagctcaacaggggttacatacttaaataaaatttgagaaaataaaaaataaacataaaaaattattaataaaaataatagaatattccataatgataatttcttcataatattatccttccttttgctagtaatataacaaaaagtttttaggataatatttagaaaaaattaaaattgtatgaattgtaaagttaatttaaagaagggaagatgttatttaggaaaggtaagtatctatgataaaatttaacgattagtcctactaatacagctgatattatagttccaattcctataccgttcattcctctaaagaatagaaaagataaaattgtagcacttgacattaatgttacatcaaatattactttaattgttccaaattcttttttagttacggttgatattgcgcttactattccttctcccggaatcataataactttaggtaaaacttcaagagtaattccgaaagcaagaattgcacatcctaaaattaaaaatattccttttgttataaaagtttgtgggtttaaaaaataaagcatattcatgcttatatcgataaataaactaaatactatattaaccactatttgtaaaagttgtatgatttgaaaatttttacgaagaagaataatttgtatgataataaataacatattcattataaatgtaaattctccaagagtaggagtaaatttaaggcttaatacacaaggaagactggaaataggtgatgttccaagtgctgcttttgtaataaaagcaataccaaaggaatttataataactccgataatgaaaacaagatatcttttaaataaactttcttttgccatgtaattatcaactcctttttttaatatattataaatcaattatatcaaaatttatgagtttatggaataaaaagtaataaaatataatatagtttaatatattttcatcgtttacaataattttgctcgtatagataaattatgtaaaacgtttaattgtaattgaatattaatttattatgattgtgtttggctgtttaatgctttgctttttaaaaatatataaacacctatgaaaattattattcctccgataatttgataatagaatattttttgtgaaaatataatataatcataaaaggctgcaaagataggtcctaaaagatttattacacttacggttgttgccgaaacatatttaactgcaatattaaatattgcatgtccaagcattgtgcagaaaatacataaaccaaaacagtttaaatacatttcttttggataacctgtaaaaggagttttggtaattatggcaattaaacctaatactatgctgcaaacactaaacaaaataaagaggaaagtatattcctctatatctttaagtgctttctttgaacataaaagatatgcacaaaagaacaatgcagtaaataaagagataacaaatccaataaaagaaccgccttcttttgaactaagtaaggtaaatattcctatgaaaataagacctaaaatagcaataatcattgcatttatgccttttttatttattttttccttaaaaagaaaatatgatgcaatggctattgttataggttgtagtgcacctgtgatagttgatataaaaccatttgtatacataagtgaagaaaaataacaaaaaaaatgaagagccataaaaataccgccaagcaagcagtattttaggttatgccattttaggtctaaagaatgatttctttgtctataaaaaacaaaaggaaccataataagagcagaaaagctcaatctatagaacccgattattataggcatacctccataacttaatgcatttcttgtaaagattactgccgtatttgcaaaaagaacagaaagaattaatatgatataaaattttttactattattcattgcctaaactcttattaaattttaagccacacacccaccatcgacatgatagaatcaagtgcttacccgagtatagactcaaatcaggtgatttcggggcacatcatagcacttacttaccactgcttgctctcgcacctgatggagtttgtaaggtataattgcacgaagcccaattctcaacatccataaaggagtgctaaccttaattgtatcagcctcaaagcgggaattcggtcttgctatagcggattgcaagtacagggcaccgctaactccccacttagtgtggcttattaattataaattttttaaaaggttaagtcaaggggaaagggaagaataatatttatatattaaatatggtatataaataaaatattgaaattttatatatttataattttatgtgattatttgttctatttgaattaaaaagcagagggggctctgctttttaatttatatcttttatttcatttttcttgatttcaggaagtaccgttagaagcattgttatgaaacaggccgctcctccgataaaattcgatattggttcagcccaaaatactccgtttacatggtaagaaaagaattttggtaaaataatagttaaaggtacaacaatgataacttttctaaatatcgaaaagaataccgcatgttttgattttcctagggatacaaagactttttgtcctgcaaattgaagagccatcatgaaaaatccaaagaagtaaatttcaatagcaggtatgctttttgaaattaaatttgggtcatgattgaatatttttataaatatatccggaaattctattaccacaaaccatgctatgaaagtatataaaatacatgttatacacatgaattttattgctttttttaaacggtcgtatttttttgctccgtaattataacttagtataggccctgctccgtctgtaagccccattacgggaagagtgaatatttctctgatggaatttagtatggtcattacacctacgtataaatcaccgccgtatacttgtatggtagcattgcatactacttgtacggtgctgttagtaacggccataataaatcccgacattccaagacctataattttttttattctgtttaattttaatttcattgtttcttttgtaagttttatgagagcttttttgcttgttaaaaaatggagtacccatatgctagaaagaaactgagatataatagttgcagttgcggcaccttttacacccatgtttagataaaatataaagaaaggatcaagtattatatttactcctgcaccaaaaagagatgttaacattcctatttttgcgaaaccttgtgcattaataaaactgttcattccaaggctagtcattacgaaaatatttccaagcagatatataattatatatgcacttgcaaagggatatgttgcgtcacttgtgccaaataaatataatataggtttatgaaaagtgattcctattactgtaagaaataaagcaacgataatcatcattacaaaagcatttcccattatattacctgcttcttcatcgttccctctgcctctttccatagaaaacaaaggagttccaccgatgctgaataagtttgtaaatgccgttacaatcatgattatcggaaaacaaagcccaagtccagtaagggcaagtgttcctgtttgtggtattcttcctatgtaaattctgtctatcatgttgtaaagaaggtttataagttgtgccattgtcattggtattgcaagttttagtatatgttttgacacacttccttcgccaaagtttgctgtattattcattgttcctcctttggtttattatttataattctattatatacctttacattgcttttacaaaaaaggaatgcttatttgttttaaatttatatataagttataggtaataaacaatagatttcattgttttgtttgttctgcgatttaaatataaagatttaaacgaactttttaacgaatatttataaaatcaaagaaaagtccttggatttattcaaaggactttttttatattttatttgatatagttatttttataatgcattgatttgtaaaagtctgtacctcccgatagaacttgaacatttttaaacccattttctttaagtattcttgcggcattgtaagaacgtacccctattttgcaatatggtattattgttttgtttttgttaagttcaaaacatctttgtctcagttgtccaagaggtatatgataagaaggatcaattttatacatagctctttcaaagtcttctgtaacatctaaaatgataaaatcatctttaccttctttaatcatttcatcaagttcatcatattctataaaatctaccatattgtttagaacattttctgctacatatccaagcatatttacaggatcttttgctgatgagaatggaggagcatatgcaagttcaagattttgtaaatcataaattgttgcatttaatttcattgccgtagccataacatcaattctcttgtctacaccttcttttccaactatttgtactccgaatattttaccttttttatcaaaaatcatttttaaagtaataaagtttgcatttggataatatcctgcatgagatttttgatttattattattgtgagataatctttatttttttcttttcccgcttgtttaagttgtttttcgttaagccctgttgaagcggcatttaagtcaaatatttgagcaatggaagttcccattgtcccctcgtattttttgttgtctcccgttatataatcagccaatattcttgcctgtttatttgcaggatccgcaagaggtatcattgttttttctttagaaataaagtttgctacttcaataacatctcctatggcatatatgtctttttcagatgtttccatatgttcgttaacgataattccaccttttttgttaagtgaaattcctgcattttttgcaagcaaactatttgggtttacccctattgaaagtagcaccatatcactttctacttttttcccgctttgaagtaaaatatttaattgctctttttcttccttaaaagcttttactccatcttttaaaattaaatttatgccttttgatattatttcttcatggagaagatttgccatttcaatatcaagaggtgccataacctgatcctgcatttctattatggatacatcaattccctgtcttttaagattttctgccatctcaagtccgatgaagcctcctcctattacacttgcttttttaggtttattgttagtaataaaagattttattttgtcagtatcgtttatattccataaagtaaatattttttcattatctattccctcaataggaggttttataggacttgacccagttgaaataattagtttatcgtatttttgataatactcttcatttgtaattaaattttttactttaacttgtttgttgtttttgtctatttctattacttcgttttttatttttacgtttatgttgaatttttttttcattgcttccggtgtttccaaaagtaaatttgctctttgatttattacatctcctatatagtaaggaagtccacagtttgcaaaagatatataatctcctctttcaaatatgatgatatttgcattttcttcttttcttcttaatcttgcagctaaagttgctccgcccgcaactcctcctataataacaatatttttcatgataatattttctctcctttgattttatgaattaattatatattaaaataaaatttatttcggtgacttaatcacataagcaatttattatttataaaaaatgtaattaatgttttacaatataaaagaaatttatataaaataattaaaatatctatttaaataaattatgaaagaaaaatgaaactttgaaatatacaagtaaataattaaatataaactttttagaactaaagttttatgctataattaagcggatattatttattaaaggggtaaaaatatggaaataaaaaataaatcaatgcttgccgatttttcacttttaattatggcattaatatggggaagtggatttatatttactaaaaatacattggattcattaacaggaattcaactaatatttattagatttttaatagcatttgtaacgctttttatttttaacattaaaaaacttaatttgataaaaaaatctacaatatataaaagtataattataggatttgttctttttcttggatttgcattccaaacttatggacttgtggaaacaccagcaggtaaaagtgcttttttaactgcggtatatgtagcaatagttccttttattgcaatgtttataggtgaaaataaacctgaaaagcataattttattgcagcttttcttatgataataggaatattcttccttactatgaatccaaaggaaggatttagtataaattattatgacggcattactcttataggttctatattttgggctttccatgtgttctttgttggacatttttcaaaaggagaggatcctattatactttgtatgatgcagatgttttttgcgggagtatttgcatttgtacttttactttttaacggggaaatatcaacatttaacataacaggaaatactattcctactttactttatttaggtgtaattgcttcggctgttactttccttattcaaaatgttgctcaaaaatatacttctcctacacatgcaggaatacttatgagtatggaaagtgtatttggaactatattaggtattattttccttaatgaagttttttctatgcaaatgcttgtaggtgctgttataatatttacagctttaattttagcggaaacaaaatttgaatttttaaagagaaaaactttaaaagagtaatgttaaaggagaattatgataaatacaatttttgttgaagaaataaaaaaaatagtcggtgaagaaaatgttttgttaaacgagccgatgaaaaaacacactacatttagaagtggtggagaagctgaattatacataaatgttttaagcagtgaaaatttagttgaacttattaaatatcttaaagaacataatatagaatatagtgttcttggaagaggaagtaatgttcttgttaaagatggaggaatagattcagttgttataagtacttctatgatgaaaaatttatctgttaaagataatataatagaagcagatgctggagtttctcttgctttaattgcaaacgaggctttaaaaaacgaacttgaaggttttgagtttgcaagctgtatccccggaagtcttgggggaggcgtttttatgaatgccggtgcccatggtggagaattaaaagatgtattggttgatgttactgtttttgatggaaaagatataaaagtgcttttacctgatgagcttgatttgagttatagacacagtaatgttgaagaaaaaggatatgttgttctttcggcaagaataaaacttagaaaaggcgatacggaaaagattaaaaataaaatggcagaaaataaagagtatagagtaaatgctcagccaatggaaccatcagcggggagtacctttaaacgacctgaaggatatattgcagcaaaacttattgatgatgcaggacttaagggtttccatgtaggtgatgcttacgtaagcgaaaaacacgcaggttttattgttaacaaaaataaagctaaaagcagagatattcttgaagttattgattatgtgaaaaaggaagtatacaataaatataacgtaatgcttgaagaagaagtaagaatcataggtaaagattcttaggaggtatattatgaattatgctgattttaaagttataaaagataaactggaaagaagagccaaaatattatcagtttttcctatatttatatttttggctatgatatttcaaatagtgcttttaattgttcaggtaaacacaagagcaacatggtttaattttgtacttgtggatcaattgttttccaatgcacgtatttttgcgggggttgacaatattgttctttcgattatgttttacggggcagttgcattgtgcgtattgataatcggatgctgtgcgtacttttgttataaaaatataagagcatcgtattccgtattaatatttttatacttgatagattctcttattgccgtattatctatcgattatgttcaaatcggtgtgcattttgtatttttgtgctttcttgtgtacggaagaagaactttaacacatcttaacagtattcccaaagaagtatggggatacggtaaataaaaaagagctttttgctctttttatttaaattttacagcagttccataggccaatatttcagctttttcctttattctaggtgatgaggcatatcttatgctgattattgcatctgcctgtttgttttgtgcaactttgaccatgttttttgttgcgtctgctcttgctttgctaaaactgtttgtttgaattccttcgcctcttaccattcccaatatttccaattctttacccggaattgtctctgtggttgtcaacataatatcgttcttcatgagttactcctttttgttttttatattttaaactatacactatatttgcttgttaaggaagaggatatattattttatttttaattaaatgattaaaaaataaataaaataataaataaaaaagagccaattgtttagctcttttatttgaattttacggcagttccgtaagcgaaaacttctgctgcgccttgcataattgatgatgaagaataccttaacgcaacgattgcatccgcacccatgttttctgcttccataaccattcttttggttgccatcgctcttgattcgtccatcatttgtgtgtaagatttaagttctcctcctacaagattcttaaatgtttgcgaaatgtctttccccacgttttttgtttgaatgcaagaaccttttgcaagtcctaaagcttctatttcctttccaggaactgtttcagtagttactaagatcatcttcttctcctttctcaatttcttttaatctttctgaaactgcattaatcattgtttttattaaaaatatcattattaaagttataattactttaaaaattaaagaaatatttaaaaatatgattgataatatatatattataagaagaatacaaataagtattccaattataataggtgctattttttctttgtttttatctttcactttttcacctaaaaaattatatcttcaagaaatctgtttcttatatcgtttatttgtttatttgtaacgtcacatgataataaataattttcaaaagaagaatattcatccattatatattctattgttgcatctataaattcgggttttgatagaaatactcttgattttgttatgttatattctcttacaaaattaggatcttctcccatatatgtatatgaaacttgatagtttgcaactatgtcttttaagcttacgtttgcaatgccaagaagcagcattgaaacaattccagttctgtcttttcctgcggtacagttaaatataagtcctccatttaggttatttgatattatatcaaatatgtctttgattgcttttttattagacagtctttttatatatccttgtatcatatcaaagtagccgtcttcttttgttatgtctgcctgcatatcttttacgcttagtggcacattataatattttatgccgtctatattttttagtttacttggtttttctttaacttcttcttcacttcttaaatccagcactgtttttataccgtatttaatcagaaaatcaatatcttcgtttgttataatgcttaaagatgaagaacgtataaattctttatattttgttatttttttatcttttgtaatataaccaccaaggtctcttgtgttttgtgttccttttagtggaagtgttccggaaatatgtagttctttaatattcattttaattttccctttttattttattgtaccataaaatttttatttaatatgtcttttgttaattcttaattattatttagaaaaatttaacatgtattttacctaatgattattaatttactgttataagtttgttttgaaaaaaaatttaaaatatttatttgtggatgtataattaatataagtattatattttctaataaaagggaggtagaaaaaatgagcgatattgtatttaaaaatgaagacattaatttgaaggaacataggcgtgtaagcaagaatacgggtaatgtcacttatgaaatgcatcttgtagatgatgaagatacaaagatgatggtaaaaataatgatatacccaaaaggagtttttacaccttggcatactcatgactgcgctcatggcatgtatgtaataaaaggaacattatacacgaacttaggggattttgaagcgggaagttttgtttggtttaaagaaggaagtaaggcttttcacggaagtaaagatgaagatgttgaagtgttgtttataacaaataaagaattcaatataaattacttataaaaaagagcattttaaatgctcttttttctcatgtctattatttgtatattgtagttttttaatttttctaaaaatatattgtagcctatatcatcattttctatttttaatacgggattattgtcaataaataaaattgttgccatgttgataattctgcatgaagtgaattgataaaaataaaaagtgtttccctttgaatccgttattctttcgtcttctacaattacttttctgtttatggctttttgaactgaaaaaagattcattattattacaaatataaaaagtacatcccatattattgaatcatgaaatataagaccttgtttgtataatgcaaatccggctacaaccaaaattaatattactgtgtgaaatactacttttgattttggttttttcattatgaaatagtctttattatttatcgtttctgtttttttatttactgttttattcatatattttgtccataaagaaaaacaaaatattcccaaaaatattcctattattgttgcgataatactcattttttactccttaagtgttatatttattttaaccggattgtggtctgcaaaattaaactttgtatctattgtttctatgttgttaagttttatgtttggagaaagtataaaaccgtcaattacatggtactgcgtgtttgggcttttttcatcaaattcttcatttaataatcttgatgtaggagttttgtcgtcggtaacaatgttccaactttttaaaaaattatctatatcaagtttcccaggtttaaagtgtttatcttttataagagggtatttatttatatttgtattaggaaagatttgattaaaatctccgcctgctatacagtaatttcctttttcgtactctgtttttaaaatatccgtaagtatctttgtttgttttattttcccttctcctttgtcatatgcttccaaatgtagatttaccagaataagttctttttttgaatttttaatcttaactctttcaacaagaagacatcgttttaattggcataatcttattggatatttaaaagaaacaggaagagaatatctttttgccgaaattatttcatatggatttagagttaatattccgctttcaacttttcctattgtgtctttaattgggtatgggatatatttacatgaaaaattttttgcaaaataagctgtctttttaaatacttttgataagtatcttacttggtttgtattatatcctctttttgactttgtgtctatttcttgtataaaaattatgtcggcgtttgtttttcttatattttcttcgattcctttaaggtttcttattaccattttttttgattctattctggttcttttcccaccgtccatgaaaaagtcactgtcggcactatcgttacagtagcctatattatatgtaagaacacttaaagaatcgttaatatgaagttctttttcttcgccttttcttataagaagtgcatcttctatttcttcaggtttatattcatttattgttaaataaaaaagtaaggataaaataagtattataagtaatcctattaaagcagttattattgtgaatatcattttctttctccctttttataaattatatcataaaaaaataaaagaagaatatatcctcttttatttgtatgaattgatattttttaattgtttacttttaattttttccatgtagtgttcttttgattcaattattgcacaccacttatcaaccaaacatattataattgcttctttgctttttgggatggctctaagagttagaggccacatatgagaatgtataatgttttcttctttttttgttaattcaaaatgtttctttgcgttttcaagtgctgctttaggatgattaaacccatgcattttttttctttctactgttttatcgtgccagtcgtaaagatagaaatcatgaagcattgctcctcttagaagttgtttttcctgtatctttaaattaaattttttagataaaatataactgtataaagcgacatttaaagagtgcgcataggttgttgttccaccatgctgtatatatccttgcattttttgtacttctttatttgaaattatttcttttatttcattaaagaaaatcattttttcttctcttgtcatttttttaccaccttaaaagtattatattatatttttatattaatacatatatattatgaacttattaagaaaaaattatattttttttaaatttttaaataaaaaattacaaaaagttattgacatattttaattttttatatataataataaagctttatgagtttgcggatgtggcggaattggcagacgcgctagacttaggatctagtacttcggtgtgggggttcgactcccttcatccgcaccagtttaaaattaaaccgattgttttacaatcggtttttttgttttatattaaatattatatatattttaattttacaaaaaaggagcataagctcctttttatttttttattaaaagcttttctccaggatgaattagttcaaggtggtttagtttaattaaggcatctttcgttgtattatatttttctgctatttcttttaaggtgtcaccgtcttttactgtataggtgatatattccttttgtttatttttttcttcatctgtaattaaaatttcttctttgaatctatccatatctacatgcccgcttatacctttaacatctcctctgctggaatattgaaatcctgaccattttgaccactcgcctgttgtatatggacttcttactccataatcggcaatccataatggatatttgttaaggtctttttcccagactgtttgtacatcgtatgcatttgaatagaaagcaggtttataacccagtaagttttccaaagtttccatatatactttagcaatgtcattacattcttttttgcttaatccgtcaagttgttcaaaatccatggcaggtcttagttgttggtctttattttttataagagaataaaagaaatgagcctgttctctagcctgtcttgtatttcttgcggttacgtaatgataaaatccaatttttaaatcttcttttttagcttctttatagtttctttcaaatttagtgtctgtataattgcttccttgtcctgcccttatataaacagcttctatgccatctttttttacttctttaaaattaatatctccttgccaaacgcttacgtctatgcctttatattcgctgtttgcgctaatcattccggcagaacatacacaaatcaaaaaacaaatgcataatattattactgcttttttattttttttcatatactacctcctcaaggtataatatggttttataaaaaatctgctacagaaaagagagtatataaaatatttcgtttttgtaatttccccatattatttattttataaagatataatgagattatatggacatgttcttaagggaaaaattaagaaattaaaagattagtgataatcatatttttaatatgaaataaatttgtgttataaaaattataaacagaggttttattatgagaaaaataattaaattcttattgcttttatctattatagggctttcttacataacaataaaagatcctacaatgatttcaagaatgcaggataaaataactggttcgataaaaagtgaagttgaatcaaacaaaagtaaaataaccgtttattataaaacggcagattcatatgttgtgcctcttacaagaatagtttcaagtgaagaagcaaaatttgataacgtaataaatcttatgacagataatgaagaaaacggagaagtagcaagtaaaaacggacttttcccaacggtaattgcaggtagtattaaaagtgtaaaattagaagataatacagcaaaggtggatttaagtgaaaaggctcaatttgtggatgaagaagatgaaaaagcatttattatttcaattgtttatgctcttactgaatttgagaatgttgacagcgtaagttttgaaatgggagataaagaaactcttacatatggcagtgaaatgaataaattatattatcgtgaaaacataaatgaaattgagaaaaataaaaattcaaaatcaaaacatactatgtatattgctaaaaaatgtgaaaacgtatataattatataccgtatagtgtgtatacagataaatcagatttaagcttaaaagatatacttataaatcattttaccatatgcaatacgaaaaaatattcttcaatgatatttgcaaccacagcaaatatagaagatgtaatagtaaaaggggagagtgtatatatacatttaagcaaagaattttctttaatggacaagacaatgttaagtttatataaaaacagtgttgcacttacggtaaaagaaaattctgatgatataaaaaaagttcgatttgtgatagaccaaaatgataataaagatggtataattgaaactgaacttgtaaacgactattcaaacgaagaaagacaataaaggagtgagttgatggaaagaattgataaaagaaattatgatgaaaaaagaccggtaaaaatcacaagaaattatacaatgtatcctgatggatgcgttttaatagaggtagggaatacaaaagttatatgttctgcttttatagaaaataaagttcctccgtttttaagaggagagggaacaggatggataacatgtgaatattcaatgttaccttcttcaacacaaacaagaaaaaaaagagatataaacagacttaaattagacggaagaagtgcagaaatacaaagacttataggcagaagtttaagaagtgttgttgatttatcaattcttggagaaaaaacaataatgatagactgcgatgttatccaagctgacggaggtacaagagttgcaagtattaccggagcgtttgttgctttatatgatgctttaaataaaatggttgaaaagggagatattgaaagacttcctcttacatcttttgttgcggcaataagcgttggtattgtagataacgaacctcttcttgacttatgttatgttgaagattcaagtgcaattgcggatatgaatgttgtaatgaacgaatatggtgaatttattgaacttggtgtaacaggagaagaaagacctgtaaaagaagaagaacttacaaaacttatttctcttgcaaaaaaaggaataaaagaattaattgatattcaaagagaagttttagggcttagtaaatagaggttaaaatgaaagaagtaataatagcatctgcaaataaacataaattagaagaaataaaaagtatattaacagattataaagtaataagcatggaagaagcaggctttgttgatgatattgttgaagatggaaaaagctttgaagaaaatgcacttataaaagctaaagccatcaataaaaaaactggtaagcttgttttaggtgatgattccggacttatggtagattatttaaacggagagcccggaatatattctgcaagatatgcaggagaagaaaaagatgatgataagaataataagaaactattaaaagctttggaaggtgtaaaaaaagaagacagaaaagctaaatttgtatgctgtgtaggaatatgttatgaagacggaagtgttgaaaccgtaagaggtgaagttgagggggaaataggttttaaagaagtcggagatggcggctttgggtatgatcctttgttttatatagaaagtcttgataaaacttatgctgaacttacatttgacgaaaagaattcagtaagtcacagaagaagagcttttacaaaagctaaagaaatacttgataaaaaacttaaatgagtcgaggtgtaatatggacaaaatactcatagtaagcgacacacacggagatatagaaacacttgagaaagttttaagaaaggaaaagaaatttaattatctttttcacttgggcgatcatcataacgatatagatgatgttgattttgatttaacaaatgttgaagtaaaaaaagtcagaggcaattgtgactttatgaaggagatagaagaaatcttttttgaatttcatggtaaaaaaatttttatgactcacggacatttgtacggagtaaaaaatacttatagttcgattttttataaagcatgtgaaataggtgcggatattgttttgtttggacatactcatgaaaaactaaacataaatatgagcggtgttcatttgtttaacccgggaactttaagcatgagaggctatggcaaaagaagttatggaataatggaaatagacgaaaagggaaattacaaaataacacataaatatatataggagttttaatgaagaaagataatataataaaaaagatatttttatgtatatatcccgttattttttggttgatttctcaagtaggagtaagtattgcttttcagttttactatgcattaacaagcatgaaaaagggaatatatgacttagaggatttaacatcatacataagtgaaaatactgtttttattctattaatatcttctttgattaatattatattttttggatttattttattaaaaaataagaaactacattttcatttatatgaaaatcaaaaaaatattaaatatatcgtaagtattattttccttggaatatcattttttatgttttccatgggtataattgatatttttgatcttacaaaatattcatccagttatacggaaacaatggctttgctttcctcaggaggagtcttaattaatattatttctgttggcattattacccccataagcgaagaatttatgttaaggagagtagtatataataacttaaaaagatatgttaattttaaaaccgcaataattttacaggcgttgatttttggcatcatgcatatgaatataattcaaagtacatatgcggttattgcgggaataataattggatatatttatgagaagtcacaaagtcttattatgtcatgtgtttttcatataagttttaatatttgcaatcatcttttttcacttccgattttatcggatattatgagttatagtttacttatgaccattataggtgttttaattttttatatatcatttaaatattttttaaatgcaaataaaaagataacttaggttatcttttttttatgaaaacaatttgtgaaaacaaaatgaaaaataaaatttttttattgacaattaaaaaaatattcatataatagttaggtagctaacatgatagttaggtaactaacataataagagggtaaattatgaaagcaaaaaaagaagttggaatgataataagacgattatcaaatgaaattagtaaagaaatgaataaaaaaatggcagcttatggcatcacaggtgttcaaggaagaataatttgtcatgttacagaatcagaaggagatatattccaaaaagatattgaagcatgtttgttttatagacgttctaccgttacaggaatattgaataccatggaagaaaatgggcttattgaaagagtaagtgtagattatgatgcaaggcttaaaaaaattgttgttacaaagaaaggtttgtgcataaaatcacaaataggaaaagatattaaaaatatggaaagaacattaaaaaatgggctttctaaagaggaaattgatgctttttttgcgataacagaaaaaatgttaaataatttcaaatagttactattttcttattatgaaattaattttgttgggaggtatatgtatgttaaaaacattaatgggttccattagagaatttaaaaaagattcttttcttgcacctttttatgtaattattgaagtattaatggaagtattaatacctttttatatggctgatattattgatatcggtattgcaaacggaaatcttaattacataataaaattagggttgtttttattctttttagcaattatttctctaataacaggtactttggcagggaaatatgccgcaaaagcttctgcgggatttgccagaaatttaagaaaagatatgttttataaaattcaagatttttcatttgcaaacatagataaattttctactgcaagtttggttacaaggcttacaactgatgttacaaatgttcaaatggcttatcaaatgatagtaagacttcttataagagcaccaatcatgttgatatttgcattgtttttcacaattaaaattaattttgatattgctattatattctttatagcaattccggtgcttgcattattacttttcttaatagctattaaagctcatccacattttgaaagagtatttaatacatatgatagactaaatagtgttgttcaagaaaacgtaacgggtataagagttgttaaggcatatgtaagagaagatcatgaaattgaaaaatttgatggtatttctaaacttatttataaattctttacaaaagccgaaaaaatagtttctcttaatgctccggtaatgcaatttacaatatatacatgtattcttcttatttcatatttttctgcaaggtttattgttgtgggaacaatgacaacaggagagttaacaagtcttgttgtatacgcaagccagatattatcaagtttaatggttttatcaatggtatttgttatggttttaatggcacaaacttcagcagaaagaattgtggaagtattagttgaagaaagtactttaaaaaataaagaaaatcctgttatggatgttaaagatggttctattgactttataaatgtagattttacatatggaaaagatgaaggaaacggaaacaatcttcctctaaaagatataaatttacatattgattcaggtgagactgtcggagttataggtagtacaggtagttcaaaatcttctcttgttcagcttattccaagactttacgatgttactaaaggtcaggttaaagtcggaggtatagatgtaagggattatgatttggaaactttaagaaaccaagttgcaatggttcttcaaaagaatacactattctctggaacaataaaagaaaacttaagatggggagatcctgatgcaacagatgcagaaattattcaagcatcaatgcttgcgcaagcagatagttttgttagtgaattcccagataaatacaatacaaaaatagagcaaggcggtacaaatgtttcaggtggacaaaaacaacgtttatgtattgcaagagcacttcttaaaaaacctaagatacttatcttagatgactctacaagtgccgtagatacaaaaacagatgctctaatcagacaagcttttagagaaaaaataccgggaactacaaaaattattattgcccaaagaatttcttcagttgaagatgccgacaagataattgttcttgataatggtagaattgaccaaatcggtactcatgaagaacttctaaagacaaatgcaatatatcaagatgtatataattctcaaatgaagggaggccaagaataatggataaaagaacaaataaaaagcctcattatttgaaaacagctgctagacttttaaaatatgcactaaaaagttataaaatacaatttatattcgtatttgtttctattattataagttctattgcaagtatggcaagttctgtatttttgatgtacttgatagatgattgtattacacctttaataaatagtgttgctcctgattttacaattgttgtaagagcgattttaacatttgcttgtatatattatgttggtgtagcttgtacattcatttatatgagattaatggtaaatatcggtcaaggtgttcttaaaaaagtaagagatgatatgtttgaacatatgcagactttatcaataagatactttgatactcatcctcacggagaacttatgagtctttacacaaatgataccgatactttaagacagatgatttgtcaaagtttacctcaagtattttctgcaatagtaacagttgttgcggtattctgtgcaatgatttatattagcattcctttatctcttcttgcaatttgcatgattgcaattatgacacttgcaaccaaaataattggtggaaaaagtggtgaatactttgcaaaacaacaaagaaacataggtatcctagatggttatgtggaagaaatgatgagtggacaaaaagtagttaaagtattctgtcacgaagaacaaagtaaggtggactttgataaaataaatgatcagctttatgaaagttctgcaaaggcaaataaatatgctaacattattattcccgtaatagcgaatattggatatatacaatatgttttaacagctattttaggtggtgcacttgccatttcaggcgttggaggacttactcttggtggtattgcttcattccttcaacttacaagaaactttaacttcccattcagtcaaatttcaggtcagttaaaccctataatcatggctcttgcaggagctgagagaatatttgatatgatggatgaagaaggggaacaagatgacggatatgttactttagttaatgcaaatattgatgaagatggtaatattacggaaagtgaaaagagaacaggaaaatgggcttggaaacatcctcatggagacggaagcgtaacttatactcagttaaatggtgatgttagatttattgacatgacgtttgggtataatcctgaaaaaatagttttacataaattaaatatttatgcaaaacccggtcaaaaaattgcctttgtaggttcaaccggcgcaggaaaaacaacaataacaaacttaataaacagattctatgatgttaccgatggtaaaatcagatatgatggaatcaatgtaaataaaataaagaaagaagatttaagaaggtctcttggtatagttttacaagatacaaacttgtttacgggaacaataaaagaaaatatcagatatggtaaacttgatgcaacagatgaagaagtatatgctgctgcaaaactagtaaatgccgaccattttattaagatgttacctgaaggatatgatacggttatttctggaacaggtgaagaattatctcaaggacaaagacagcttcttagtatagcaagagctgctcttaataaccctcctgtacttattcttgatgaagcaacatcaagtattgatacaagaacagaaaaaatcgttcaagacggtatggataagttgatggaaggaagaaccgtatttgttattgctcatagactttctacaataagaaactcagacgcaattatagttttggaacatggtactattattgaaagaggtaaccatgaagaacttatcaaaaaacacggtacatattacagactatataccggtgctttggaattatcataataaaaaaaagaggcttatgcctcttttttttataggtagtaattctctttatattgtatttttattaattttttattttataagaaaataaagaatataaaaaaattactggtaaataatattaattgataaatttaaggaggattaaaatgaaacttagaataaataaagacagctgtatttcctgtggtctttgtacatccatatgtgaagatatatttgaaatagagtctgatggtaaagcaggtgtaataaggaatcctgaaaatgattctgaaataacacttgcaagggaagcaatagaaagctgtcctgtaaatgcaataagtaagtattaaaaaaacaagctaaatgcttgtttttatattactttatataattcatcttgtgatggcggagataatatttcttttactccgttttttaaaatgtaaatttctttttcctttgttaaatatcctattgtggatgaaggtatattttgtttatttaattcttctattaatttctcgtcattatcggttataaacaacattactccgctggatattagcttatatgggtttatgttaaaatgctttgcgattttttttgtttcatctaaaattaatattttatcaatatctataattgccccaagccctgaattttctgccatttcccaaactccccctaaaataccgccttctgttgcatcatgaagaagactcacgttaagattttttgctattaaaccttcttttattacggaagtatcttttattaattttgatgtttttaatatttcttcttttgtcaaaaacttttccacttcatcttttaagtcaagagtaataatggcacttccttcaagcccagcatatttgctcattacaattttatcattagcttttggggtaggattaacaatattttcttttcttccgatacatactccgcttaaaataaatttatttacgcttgaagttacttctgtatgtcctccgattaaatcaacattattttcttcgcaggttagaagaatttcatctattatttcttctacatcttctatattggcataggttggaataagcattgttaccatcattgcaacaggtgttgccattgatgttgcaatatcgttgcatgaaatatttacgcatagtcttcctattccgtttttgcttcccgttattgggtctgtggatattgaaaataaatctccttcaaaatttaaaagggcagtgtctttacctattcctgcacctattaaaacttctttgttatttatattaattttatcaaataggattttttgtaatgtatgattggttaattttccttcttccatgtttttccttcataataaaaagatatttttttatattttagcacaaaaacgtcaatactcatagtaattacttatatttggagaggattcatgattaatattatttgtacccttgattgtaaatttcaagaaaaaggagtgtgtacattaaatacggtacctttttatatttcatcactaaacgaaaagtgtatgtattatcttcctaaagatgaaaaaaatgatgaagatataaaagataatgaaaaactcacttaaaacaagtgagtttttttatttttctattttaaattaagttgaaaaattagacatattttgatattataactgtgaatgtgtaataaaaaggaataataagatttttcgtttaaagtcttatatataaactatttggaggtaaataaaagaagttatggaaaaagttgatccaaaagttttggttaatcaaaagaaaaatgctattaaatattgtggtgcaacaaatcctgaatgtatcgatgattatatagcatttgatggttacaaagcaaaagaaaaagttttaaaaggcgaagttgatgtaattaaacttgcaagtgatgctttacttgttgatagaagaaaacaagacgaactttgctgtgataattggaaaggtgctgaggttgttgtttgcgaaacactagatgctttagctgctgcagacaataaagttttaatcgaagctcctcacgtaattgttgaatcaatgcttattgttatggaagtaagcggtgcaaaagaaggttatattgtagcaaaagatgaccttgcatttagaagagtatcaaaagctgttaacgatgcaaaagcttacggtttattagataaagaaataagtgttgtaaaagaaagcaaagaaggcttaaatgtaaatgcagaaattttagctaacttacttgtaattgttcaagacagctataaaacacttcctgaaaaaggatttaaaggtgttgcaatcggtggtaaagtaaaaaatcctggaatttacaatgttgaaaacggcgttacatatgaacaacttattgaacttgcaggcggtgcaacaggaaatgttaaatctatcaaagtaggagctccttatggtgaatatttaccagcttctgaagtttctaaacctgtaaactttatggctttaatgatgaatggaataataagaggtactgctcttgttgttgttatcgatgaaacaactgatatggcaaaagaaatatcagattacttacaattcttattaattcaatcttgcggtaaatgtttcccttgtaaggttggggtaaaaagaatggatgaaatggttaagaaaatcgtttctgatatttcagaaaaagatgattacagcaaagtaaaagcaattgcaaaaaatatgagtatcggaactctttgccctataggacaaaagggtgcagctcctattttaagtgcacttgaaaatttcagttctgattttataaaagagtagtcaaggagtaaatgaaaagatggtaaatttaaagataaataatgttgatgtttgcgttgaagataaaacaacggttcttgaagctgcaagacaaatcggaattaatattcctacattatgtttcttagaacataacaaaattggtgcttgtagaatgtgcgtagttgaaattaaaggttctgatgttttaagaagtgcttgtaacttccctgtaaaagaaggaatggaagtatttacaaactctcctaaagtaagagaatcaagaaaaaatacaatggaacttacactttctgaccataacagagattgtacaacttgtataagaagcggaaactgtgaacttcaaactcttgcaaatgatttaggagtaagcacagttcctttcagcggagatttttcatcagatgcatatgatgataaatctgtttcaatcgtaagagatgaatctaaatgtattttctgtaaaagatgtataaacacatgtagtaaaattcaaggtatcggtgctttaatcggtaaagataacggatttgattcaaaagcaagacctgttaaaggtgattatttagctgatacaaactgtatcaactgtggacaatgtgttattaactgtcctgtaggtgccttaactgaaaaagtaaatgtagatgaagtatgggaagcattatgtgatgaaaacaaacatgttgttgttcaacctgctcctgcaataagagctgctcttggagaagaattcggatatgaaatcggcacagatgtaacaggtaaaatggttgctgctttaagaagacttggcttcgataaagtttttgatacagactttggtgctgatatgacaattatggaagaagctcatgaacttgtagacagagttacaaacggaggaactcttccaatgcttacaagctgttgtccttcatgggttaaattctgtgaacaagaattcccagaacttattccaaacctttcttcttgtaaatcacctcaagcgatggcaggtgctttaataaaaacacattatgctgaaacaaataatattaatcctgatgatatttatgttgtaagtgttatgccttgtgttgctaagaaatttgaagttggaagagaacaattaatggaaggcgataactatgacagtgatgtatgtatcacaacaagagaacttgcaagaatgattaaagaagcaggtattgactttaaaaatcttgaagatgaagaatttgatccaatttatggtgaaagttcaggtgccggtgtaatattcggtgcaacaggcggggttatggaagctgctgcaagaactgcagttgaagccatcaccggtgaagtatctgaaaaaattgattatgaagaagtaagaggtcttgaaggacttaaagaagctgtaatcaaagctggtgataaagaaataaaagttgctgttgttcacggtggagcaaacataagaaaacttatggataaagttaaaaaaggtgaaactgattatgactttatcgaatgtatggcatgccctggcggatgtgtaaacggtggtggtcaaccaatcgtaaacagtcaacttattaatgcaggtttatctcttgcaaaagaaagagcaaaagtattatataaccaagataagaacgttagaccaacaagaaaatctcatgataatccagcggttaaaaaagtttatgaagaatatttaggtgagccaaattctcataaagctcatgaaattttacatacaacatatgttgacagaagtaaagatatattaaaataaaaaagacccttaagggtcttttttattatttctctttctcttcaaaaagagataaaattgtatccattacctcattgttatcataagaaattacatatataaaataatttccgttttcgtagaatgttctgtttaagacaagattgtattctgtcttatcttgttctttccatattttttcataatttatcatgtatttatctaatgcttcttttactttttctttattttcttcttttacgtttgcaattatgaataaagagcttttagaagagagtgcagattgttttattataatttcattgaaatcttcattattcaacttatatatgttttttatttcttcatcgcttggtattgtcatattgtagaatataggaagttttttgccgtttttttcataggttaaattttcaagttttattgctgttttatttagattaatattcaatatgcagtttttactgtaaaggcataagggaaacaaaaatgagtttatgtataaatttatttttatgggttatgtattcaataagcattttagatatttctactgctcttacggattctactacatttgttattacagcaatttatttaataaagaattataagaaaaataatatattaacaaatgaagatactctttaggggtatcttttattatttgtaaataaatcgtttatatggtaatatatttaaaaattaaatttattggtgaaaagtatggacgaaaataaaaacagagaagaagcaaagacttttgacgattatttgatgacttatttaactgatgataaaaatattttagatgaaaaagacagtgtagaaaaagataaaatgcttcttgagaaagaaaattacgatataagtattcaaaaaaaatattttgaacagttagaggatgaaaagaaaaaggaaaacaacctttacgaagatgataataagtcttttatagaagaaaataacgaagataaagaaattcaaaataacatttatcaaaaagataataaaaattcaaatgcagatttccttccagatttagcaatgatactttcacttgctttggttgtgggaatggttatgataaaaggcattggagtttttcatggacttgaaagcctgcttttcttaatgctttgggcaagtgtactggtttatgtttcaattatcattcacgaaggcggacattttgtttttggactactatcgggatataagtttgcttcttttagaatagcaaatatgatgtttataaaaagtggaaaaaggcttacatataaaaaatatcatataccgggaacaggtggacaatgtttaatgattcctcctgatataaaaagtgatgattatgatttcccttatgttttatatagctttggtggtgtgattttcaatttattatttggaataatctgttttttattatatatttctcttccttatattatagttctttcggaaggttttatagttgcaagtgcattaagtttatattttgcaatgttaaacggaatcccaagacgtgttggggggatagccaatgatggtgcaaatgctctttaccttgatgaagatttgaatacaaaaaaagctttttatgctcagcttaaaattaatggtcttcttacaaaaggcataagatataaggatatggatgaaaggctttttgaagtagatgaaaaagcgaattgtaaaaatcctttggttagcgcaatgtttaattttagagtatgttatctaattgataaaagagaatttgataaagcaagagagcttatagaatattcattaaataacgttgatgatatgttaagtgttcataaaagtgaaataaaaagcgaattattctttttggaacttattggtgattgcagggatgaaaaaattacacagatatacgatgaagatttaaaaaggtatatagaagtaacacagaattactatatttcaagaagaagacagctttatgcatacgaacttttatataataaagatgaagaaaaagcaagagaacaacttgatgcatttaaggttattggaaagaattatccttatgaagtagaaattgatggagagatagaacttttacatcttgtccatgataaagctttggaaagaggaataatagaagaagacaacaaagaagaataaaaaaaagaaaccataatggtttcttttttttatctacgtcttcttactccatacatatatccgccttccattgttacaatatcgtttattgtaattacacagtcgggaacgttttgatatgcaatattcatagcttcttcaactctttttctgtttacatgaagttttaaaatatatcttgtatgattaaaaccttcacctttcattattgttacgccgaatttattatctctaagtgtttttgcaaggtcttcacctgtaacacctcttacgtttatttccatgcttacatatccaagagcgattttcttttcaattactattccaacataaatacccactgcatatcctaaagcatagaatagagctttccataaatcttcttgaagtgtagataaaacacttgatgcaacaaatatccatagaatgataacaacaaaaccaaccagactgccaagttctttttgacctttatttattaaaacgattcttattgtgtcaagagatatttcaagaactttaaggcagaaaatcgtcatataaacgattggacctgactgcgttaaaaaattaattaaaaaatccatttttcacctctaagatatattcttacttgtagtatactattttatgtaacaaagtaaagaaaaataatttgtttttaatattgatttattttataatgttaaggaattattaaaggagagtgaatagtatgataggaataattgcttcaatggaagaagaacttaattacataaaagaaagtatggaagacgttaaaataaaaaatattaataatacggattatgttattggaaatttacatggtaaagacgttgtagttgtaagatgttttacaggtaaggtatacatggctttaacagcacaaaaacttatcgataactttgatttggatttgattattaactgcggagttgcaggaggattgaaaggcggaatgcatataggagatgttgtccttgcaacaaatgctatccagtctgatatggatgtaagggggcttggttatgaaattggacaagtacctgacattgaaataaaagattttaaacaatatgaaaaaataaacgaaacagcaaaagaattggttcaaaattatgattttaaagtttactttggaaatataatgactgctgataaatttgtttcttcaaaggaagataaagaatatttaattgaaaaatttgatggatattgcacagatatggaaacagcttctcttggtgaagtttgttatgtaaacaaaataaactttgcagggataagaggaataagtgacagtgcggacgaaggtgcaaatactgattttagagaaaacttgaaaaaagcaagtgataactgcgcaattcttctttgcgatataataaaagcaatgtagtatgacaggtagattatggatgtagtaacaaatatatctaaaacaaaaagagaatataacgtaacattaaatgatgaaataattttaaggcttgacaaaaaagtaatagacaaattagctgttatggatgaagtggagatggaagagcttgtaaaagaaagctatgattatttatatgaaagcggacttaacttaagtcttaattatctttcttatgccataagatgtgaaatggagattattacttatttagaaaaaaaacattttcctgaaattgtcattaatgatattttaaacaggttacttgagcttaaatatgtaaatgactatgattattctcaaagtttcataagaacaaaagtgtcttcacttacgggtagaaacaaaataaaaaatgaccttataaataaaggaataaaacctgatattgtatattcttccttaaatgagtattttagcgaagaggaagaaagagaaaatttaattgaatttattacaaaacaaaataacaaacacaaagagcttttcttaagagaaaagaaagataagataataaattctgctataagaaaaggatatgattataaacttgtaaattctcttattgatgaatatatttctgaagaagattccttagtagaaaatgaaaaaataaaagagaaaataagaaaaagattttataaatatttaaacaaaggtgaagatataaaatccgttaaatataaagtatattcatttttttataataaagggtacagtgaagagattttaaacagcgtatatgaagaaattgaaagtcaaatagaagaataaaaaaagtgcttttaaagcactttttttaattattacaatttaaaataggtttgaaatatgcttgttcatgagcacaaataggacagactttaggagaagtttttccttgatatctatgtccgcattttaggcaaacccatgttgtatcatcttctcttgtaaagaatccatttttaacttcgtttttaagtttttcaaatctttcatggtgaaatttttcaacgtttgctataagttcatagtaagcagctacatcattaaagccttcttcttttgctgtttttgcaaaagaaggataaatttccgttgcttcttcgtgttcgccttttgctgcaaactgtaaattttcaagtgttgttccaagaaatgccggatagtcgctttcgcttattcttatttttgctcccggcagttctttatttattagcatcataaatctttttgcgtgatatagttcattcatggcagtttcgttaaatatatcttctatatatttatatccgtcatcatttgctcttttggcataatatgaatatctttggtaaacgccgctttcacctataaaagaactcattaagtttttaactgttttagaatttttaaattccatttcaacctccttttgttttattttttcttaaaaatagttttaatattcaaataaaaataatatgtaaattattgtttaaaattttattgtcttaatttaaaaactttgattataaaaatatttaagaaaattttaataaaattgacaagttttttataagaaataatttttataatatccgtgtaaagaggtgatattatgagaatttttgaaaaaaattataaagtttatttaatgttttcaagatcaaatactttgctttcaaaggcaatatatcaaagaacaaaagagccttatacacatgttgcgatttcgactgatgaaaactttagggaattttattcttttgggagaagatatacaaattttatgcttcccgcaggatttgcaaaggaatcaccttttgatggtttatataaaagaaatcaagatataaaaataaaaattgtatcaattaatataaataaacatcaatttgacaaaattaacaatactattgaaatgatgtataaaaacagattcaaatataaatatgatattttaggattaatgttttgtaataaaaatattactttaaacagacaaaattataaattttgttctcagtttgtaagtgaaattttaaatatgaatgaaattatagattttgaaaaaggtagtaagcatatcagaccaagtgaaattgcatttagagatgagtttgaaacggtttttgaaggaagtgtttacgaactcaacaatttatataatacacaaagggtttggaattattcttttgaagataatctaaatttggtatacaactatgaataaaaagaaaatagctttaatttctataatttcaattgcggttttggttttgcttggtattttttttacgttagatataaataagattttagaatacgcgaagtcaatgcctcatggaataaaagaattgtttatgattttaattgtaactcttcaaatattcattgcttttattccgggagaacctattgaacttgcggcaggatatatgtttggctccctatggggaactataatatgcttgattggctcgtttttagggacaatagttgtatattatcttgttaaaacttttggaagtaaagtaataaaccttatgtttaaaaaagaacaaataaaaaaggttgaaggacttttcgaaaaaaagaaaaatttaatgtggattttcattttatttttaattccgggaacaccaaaggatgttatgacctaccttgtttctttaaccaatattaaactttacagatggcttattgttactactatcggaagaattccaagtattataacatctacttttataacaggttctattagagagcaaaattttttaatggcgattattgtaggtgttattaccgtttttttagtagtttttggatttttttattataaaaaattaaataatacttcaaaaagttgattatgttgtataaaatataattataaaaaataaaaggggaagagaaatggaacataatattttaattgttgaagatgaaaaaggtataagagacgccataataatatatttgaaaaatcaagggtataatgtatttgaagcagaaaacggaaaagaaggacttgaaataatacaaaataatgacatccatttagcaatagtagatataatgatgcctgttatggatggtattaccatggttatgaaagtaagagaaaaatatgatttccctgtaatattcttaagtgcaaaatctgaagatattgataaaattacaggattaaacataggtgccgatgattatgttacaaaaccatttgcttcaatggaattaattgcaagagtaaattcgcaaattagaagatatgaacaaattttaaatttaaaaaataatgctccaaaagaagaagaaagcaataaatatattgttggtggattggagcttgacgactacacaaaagaggtttttgctaatggtaaaaaggttaaattaactgttaaagaatatgaaatattaaaacttcttataaaaaatccaggaagagtttattctgcagaacagatatatgaacttgtatggaatgaaaaagcaatcagtactgaaaccataatggtacatattagaagacttagagaaaaaatagaagttaatcctaaaaaaccacaatacattaaagtagtttggggtgtaggatataaaatcgaaaaattataattatgggtgatatttaatgaaaaaaaaatatatttttatatcgttgttaacggtattgattgtttttttaagtagtatagccattggattatatgataatgttgaaggaaaaataacagataaatcttatgtaatcaattcatatttagtagaggatatgaaatattttactttggctaaaacaatggaattagatcctgattttaaggttttttcttttggtaaagatgttcctgaaaatgtgcaaaacagtatatatgaacgttttgaagataatatgacaagcagtgtttcactacttgaaaatgacagtaattttatatattatgtaaaaaataaggaaaacaaaaattatgtaaaaagtgatattgatgccagtaaagaaaatgataatatttattatgtgtcattttcatatgacagtaaaggtaatttgaaaagcgattcaaattattctgcttcatatttttcaaagtatcctgtttataattatatttcttcaatgtatggagattctgcttttgttgttgaagatggagctgaatattactatattgatggatacacaataccgtatgatcaaattaaaatgaatattcctaagaatatgagttttacatatgcaattccaaaggttctttctgataatggaggagcaatatcttattatattaattcatgggaaaattataatccatttaccggagtatgtcttcttataggaagtgctataatagcaatatttattttatttgctcctacaaaaatagtaaaagaggttaaaccttttaaaacatttataagttttaaaggagaggtaaatttatttttaatttcatttattattactatgtgctgtatggcttgtttggtttgtgctggatattcaattaacggaatgtttttaagccttatgaataaaataggacttagatatcctaattttatggttctggtttcaaatattcttgtatgggtagttacatttttatctattgcaataggatgtttcgatataaaatatatatttgttgaaggtatatggagattcataaaagaagatactttgatttctcttcttgttagaaaagttaaagaggtattaaacaatttaataagtattgatttaagggatcctgtaaataaaaagttaatgaaatttttatttatgaatatgctaataataattttcttaactttcttatggggatttggttctatacttgcaataatttattctgttttcttattcttcatgcttaaaaagaagacagatgagattcataataattataatactcttttaagttcaactcatgaacttgcaaaaggcaattttaatgacgaaatgaatgaagatatgggagtatttaattcattaagagatgaatttaaaaatattgaagagggttttaaagaagctgttaaagaagaaacaaaatcccagaacatgaaaacagaacttataagtaatgtaagtcatgatttaaaaacacctttaacgggaattaaaaattatgttgaacttatggggcaggagggtattccaaatgaacaaaaagaagaatatcttaaaatgctaaaccaatatattgacagattaagcaatttaatagaagatttatttgaagtaagtaaagtaaatagcggagatataaagcttgatttaatggaacttaacatagtatctttaatagagcagacaaagagtgagtgtagtgatttatttgaaagcagaaatctcgatgtaataatgaatacttatgatatgaatataaatcttttacttgatggtaacaaaacttacagggtgtttgagaatttatttaataatatatcaaaatacgccatggaaagaacaagggtatatattgatataactgaagaagatgacaaggttataatttctcttaaaaatatttctgcagcccaaatgaattttacaagtgatgaaattgtagagagatttgttagaggtgataaatcaagacatgaaagtggaagcgggcttgggcttgcaatagtaaaaagctttgttgaagctcaaggcggaagtttttctatagatattgacggagatttatttaaggctgtggttatttttaataaataataaaaagatgaatgtttaggcattcatctttttttattatgtaaaaagtttgtataaacaaaaataaatatatatatctatgttataatatataagctgaaattcgtttaaactatttctcataatatttttctaaaggagtttaaattgaaaaacaaaaaattggagttatttttggcttttgcaaatgtaggagcctttacttttgggggaggatatgcaatgattcctcttttacaaaaggaagtagttgaaaataaaaaatggattagtgaaaaagaaatgcttgatataacggcaatttcacaaagtactccagggcctcttgccataaattgtgctacatttgtaggatataaagttgatggagtgattggctccgtagttgccactttgggtgttgtgttaccgtctttttttgttattattgtagtttccgttttgtttaacatgttcagagacaatgttatagtaaacaatattttctcaggtatacaagccggggttatagttcttattttggaagccgctttaaagctttcaaagcagataaaaaacaattggtttaatcttacgttattgatagtttcgtttttaataaccgcttttactgggataaacgtaatttatgtacttattgcatgtgctttgcttggtgttttggtgcatggattaaacatcgtaaaaggagggattgaataaaatgatagcacagctttttacggtgttttttaaaataggtttgtttacttttggaggggggtacgcgatgattcctcttataaaagcagaagttatatctcataattgggcaaccgtttcagatataattgattttataggaataagcgagtctactcccggtccttttgctataaacattgcaacatttataggttttaacaaagaaggaattttaggagcagctgccgcaacacttggagttgttctgccatctctaataataatacttataataagtaaatttttctttgattttcaagataataaatatgtaaaagcagttcttgcaggacttagacctgcagttgttgggacaattgcttcttctgcttttaccatatttgcatcaatatttattacaaacggaaaagttacaaattacattggaataataattttaataataattttaatgttaaaatttaaattcaagaaaatgcatcctattatgcttattatattgtcgggtgttatggggtatttgttttacggacctcttcattttctttttccattttaaaaagccataacttttgttatggatttttttattatataaaaagcaaaaaatatacttacttattttaaactggttatatatatttttattaattttattattaacattattgtaattattataataagtattactataatgtcttcataaatatgagacaagtcaaaaccttttaaaagttcatcagtaataattttaatatattcttccattttatgccttttaatacaatttatttattatacattaacatttataagttaaaatgcagtgaaaaaaaattaaaatttatattaaatatgtattttaaagtttactttgatgcttaattaattatataataaaacagtaaaggaggtatgaaatgagaataatagttgttgcgggaatgttggcggcaggaaagagtgttgctctaagattttttcaagatagagcattttattgtgtagataatcttcctccgaaacttatagatacatttatagagctactggataaaagcgagcctaaaatagaaaatatagctattgtacttgatgtaagaggaagtgcttttttcgatgatataggtcttattttagataatttaaaagaagaaagaaatgcggaaattttatttattgatgctgatgatgatgtacttatttcaagatataaaaagaacagaagaaaacatttgatttccggaaatgacagaatagaagttgccataaaaaaagaaaggaaatcaatggaagaggttagaagaagggctgaccttataattgatacttcaaagcttaaagaaagagattttgaaaagattcttcatgattgttacagcaggtttgatgatattccgtctatttttaccattaatgttagttcctttgggtttaaatatggaatacttcatgatgcagatatagtttttgacgtaagatttcttccaaatcctttttacgaaaaggatttgaagcctttaacggggaaaaacaaagaagtttccgattatgtttttggatttgatcagaccaaagaattcatgaacaaattatatgacattatttcttttaccattccttattacataaaggaaggtaaggctcaacttgttattggaataggatgtacgggaggacgacaccgttctgttgccattgcaagtgagttagctagaagattatccgaagataattacatggtgacagaagagcatagagacataagtaaggataattaccaatattaatatttataagaaggtgattatatgaaatttaaggataaaaatattgttataataggcggagggactgggaacagtgttttattaaaggaatttaaaaaacatacagataatatcagtgccattgtaacagtttttgatgacggcggaagtaccggtaaattaagaagggatcttggtattttagcagtaggggatataagaaactgcattaccgctcttgcagaagatgaatccactatgacaaaacttatggaatatagatttacaaaaggggcattgaaaaaacattcttttggtaatttatttcttgcagctttaaatgaaataagcgaaagtttccctaaagccataaaggatataagcgatgttctcgctattaaaggtgaggtagttgctgttacaaagaatgataatgtaactttatgtgctcttcttgaaaatacagctgttgtaagcggagaatcaaagatacctaagcaggcaataaaaatgaaaacaaaagtaaaaagggtatttttatctccaaccagtgcaaaggtaaatgattatgcagttgaaaagataaataatgcggatattataattttaagcccaggaagtttgtatacatcaattattccaaatcttcttattactgatataccttatgctataagcaaaaacagaaaagctaaaaaatattttgtaacaaacataatgactcagcatggtgaaaccgatgggtttgatgttacaaaacatgtaacagaggttgaaagacatattccgtcagatcttagaatttttgatgaagtaatatacaatacggaaaaaatagataaagaagttttaaagaattacagaaaaaaacattctaaagctgtagaggcaaatttaaccaatgaaataaagaaaaaatataagtttaccggattggatcttgtcagctatgtagatggagtgataaggcataacagtaaagtattggttgaatatttaaaaaatcaaaattaaaaagactcataaagagtcttttttatgttaatgatgtaagtttaaaaacatctgatgatttccctataacaattatatgatccccttctttaaaagtgtataaaggactcggaacaggatctaaagagttagcattttttactgcaatgatgtttactttatattttcttcttatggcaagttctataattgtttttccaacccatgagttaataattggaatttcatatattgaatattcatctgttaactgtatataatcaaaaatattttttgcatttgaccttattgccaatttttctgccgtatctctttcagggtatacaacttcatctgcacctattcttaaaagaagtttcttttgtatatcactgcttgcctttgttacaacccattttgcatttaagtctttaagaagtgctgttatttccaaagatgattggaagtcttctcctatggcaacaaaacatatgtcaaaattatttactccaattgattgtagcactgcctcaattctacaatcgccgatttgagagtcggtaaattccgatgcatattccgtaattttttcttcatctttatctattatcattacatcgtttccgagctcctgcatttttcttgaaagatgttttccaaatcttcccattcctattactaaaactgatttcattttttatccctttctttaaaataatatatgtaaatttttaacctattaatattttttcagtcggtctttctataggtgctgattttttcttggcgtttaatgctatcattaatgttaaaatgcctactcttccagcgtacatcaatgaaattattactattttcgaaatcggacataatccggccgtaatacccattgatgaacctacggttccgattgctgaagaaacttcaaacattattgccaaagccgaactgttttcaaaataacaaagaatcatacatcccaataaaaatccgaatatatataatgttgaaacggcacttgcttgttttaccgtttcattttctaatttccttttgaaaatggtaatgccgttttgttgtcttgaagatgcaacggcactcattataagaacaactaaagttgtggttttcataccacctgcggttgagccgggactccctccgaccaacattagaaataccgtaaacaacgcagttccctgatgaatgtctacccagtttatcgtattaaatccggcagttctcggtgtaaccgattggaaaaaagaaactaatattttttcttttaccgaactgtctgcaattactccgtttgagttttcaaatataaagaaaattaatgctccgcctataatcagacaagttgttgcaattaatacaatttttgaatgtaattcatatctgctaaattttaatttgtgttttaatatatcactccaaactacaaatcctataccgcctatgacgataagtgacattatagttacgtttacgattatatcgtctgaatatgttgttaatgatgagaattgcccgaatttccccattaaatcgaatcctgcattacaaaacgccgatattgaatgaaatacggcattgtaaattccctctgcaattcccatatctggaataaatcttgttgccagtaaaatggcgcctattccttcgaataaaatagttcctttaactattcttaaaattagagcaactacgccaccgatttgattgcttcccgcagactgcatcaaaagttttctttcattcaaacctatttttctttttaaaaaaatagataacattgttattatcgtcataaatccaataccgcctatttgaataaggcttatgattactatttgcccgaatacagaccaatgtgtgaatgtatcatacactacaagtcccgttacgcatgtggcagatgttgccgtgaaaagagcatttaaaaaaggagtaaattccccggttcttgacgatatcggcaaagaaagaagagtccctcccgtaaatattattaataaaaatcctaatgctataatttgtgtgtaactgatttttttccctaaaatgctgttcatccttattatcccttataagtctctattttaccaattaaattaaatatatatggattttaatctttattatataaaattgcaatacaaaacatatattttatataaattttacatatactttactttttgtttttttataatgtgtattatagaaattcctttaatatttaacagtatattttgaatttaactaaaaagtccatgtaaataatggacttttttaatttaaattataattatctaaaaattgttcgtattgctgttgtttcaaatcttctattttattttgttgcgttttgtttaaaataatcattggaatacttgtaataagaaggataataagccctcccataatcatcattataaaacacttaatataagattttgatgtgctttttaatattttatcatttagttcatttacattttgtacttttgcgtattccattttgttgcaatttggacaaaagaatttttttgaataataaccatactccggtttattaataagtgctccatctttcatcttggtttttgttatactttttgattttgaaagataagtttttgtaatttcctttggctgtacatcatattctaaaccgcatttttcacatttaacatgaactttagtatctaaactttctattatctttttgtttcgtttcatacataatacaaaacaaattattatccatgataaaagcaaaatacccataataattaaaactgcaatacctatagccatttttacctcacattaattaaataaattcacttataaaatcaagtgtttcatctcttccgagattttcttgtgttgaataaattattattttatcatcatcatctaattctaaggtttgttttattatatctatattcttttttcttttgtttttgctgattttatctgcttttgtaagaacaattacaggataaatatcatttgctaaaatatcgttatacatttttatgtcgttatttgttggtttatgcctgatatccacaaggaaaaaaactataaaatccgtatttcttttttgtaaatagtcgaatattattttgctgaattgtgctttttcgcttttggatacttttgcatatccgtatcccggcatatccacaatataaaattcgttgtttatgttatagtagtttgctgttctggtttttcccggtacagaacttgttcttgcaagagattttcttccaagaagattatttataaagctggatttgcctacgtttgattttccgattaaaactatttcaagtttttcttccggtggcagctgattaaattttgctgcactggttactatttcggcactttttataatcatttattttcctcttcaaaaattattttatatacttctttcatgtgttttacaggagttatttcaaggtgttttttgatgtcttcacttatttcttcaaggtcttttacattttctttaggaattaagactttttttactcttgctcttgctgctgcaagaagtttttctcttagtcctcctattggaagaacatcacctgatagagttatttcaccggtcattgcgatgtcttctgcaactttcatatttgttagggcagatattattgcagtcgcaagagttatccctgcacttggaccgtcttttggagttgcaccttcaggaacatggatatgaatgtctttcttttcatagaaatctttatcggcgtttaacttatcggctattgttctaacgtaagttagtgcagtttttgccgattcctgcataacatctccaagatttccagtaagttcaattcttcctttaccttcagtaagaacggcttctatttttaatgtgtcaccgccgtaacttgtataagcaagtccggtaacttttcccacatattttttattgctttgtttgttgaatgttattaattcttttcctaaatattcgtgtagattttttactgtaacttctattttttcatcttcgtttaacacgattttctttgcgcattttctgcatattttagctattaatctttcaagttgtcttacacctgattccaaagtatagtctgacactattttatccaaagcggcaggagtaaatttaaggttatccttagtaagtccatgtgcttcaagttcttttttgattaagtgtttttttgcaatttcaactttttcttttggcatataaccaggtatttctattacttccattctgtctaaaagagcaggaggaattgttgctgccgtatttgctgttgcaacaaataatacatttgaaagatcaaaaggaatttcaaggtagtggtcagagaagtttgagttttgttcagggtccaatacttcaagaagagcacttgcagggtctcctttaaaatcagaaccgattttatctatttcatcaagaagaaatagtggagaatttgtttttgcctgttttattcccgcaataattcttccaggcattgcgcctatataagtccttctgtgacctgttatttctgcttcgtctcttgttccgccaactgacagacgaacgaatttcctttttgatgcttttgctattgcttttgcgattgatgttttaccaacccccggaggtccaactaagcaaacgataggtccttttagggagtttgtaagttttaatactgataagtattctattattctttccttaacttcttttaaaccgtagtggtcttcatctaaagttttttgtgcttcttttaagtcaatatccggtttttcttctttttcccaaggtaagtcaagtattgtttcaatataagtctggattactcccgcttcacttgagccgacaggtattgtatttagtctgtctatttctttttgtattttttctttgtattcttcaggaataggaagtttttctaatttttttgtatagtcacttccgcttgcacttccgtcggcattatgaagtctgtcttgtaaaacttcaattttttctctcaaataaacttctttttgaagtttttccattttttctttaacttctttttctatttcattttcaagagataaaacagaaattcttttttccaaaaccttatatacttctttatatctttgttttgtgtccgtcatacaaagtatatcttgaaaagtatcataatcaagatttaaaggcggtaaaataaggtctataagttcgtttggatttttgattgaagaaagaaatgaagaaagttcaaattctgccgtagacattttatatgcagaatatttgttgaatttttcttttaatatatttgtcattgcaatttcttcttcggttaattcttcctcagaataatttattatatccgcatttgccaaaatataaggacttgcttgtatatattcctttatttttactctgtttaaaattttaactgaaacttttattgcgttataaggaagtcttataaggtttgtaattttagccaaaaccccaacttcacgtaggttttcaaggctgatttcttccttatcggcatctatttgagcaattaaatagattaggctgtcttctttaacgctttcttccaaagccactaatgattcgcttcttgaaacgtcaaagtttgcattcattccggtaattaaagataaatctcttattgaaattgccggcagagtcatatttcccatattgcttgtgtatgtattcataatgttttgtatatttgccaattttaaaacctctttatctaaatatttaatatatgttttgattaattttattttataagaaaagaaaattaatttgaaaaagttttatttattttactttttttcttataaaatttcataaatcaagattatatcatttaaaagtgattaattcaaagtattttttataattaatcaaatttttactttaaaatacttataatttttatatttttttattatattctaatatatattacatattttataaatacgtttttaatatgtttttttgtttttttattacaaattatgtctttttatggcaaattattttctttttctgcaattttcgacaaattaaggtataaaatatttaatttcttcttaaataaaataaatgtaaattaatgaaaaaatataatattatcgttgtttttttattaattttatttagctttttgtttattcccttataagccttttccttgtatttgataggggattgtgttataattttttgtatgaattttgttgaaaatacttattttgggagaaaaaaatgcttaactcttatacaaaaaacgaagtattgaaaatgcttaaagatgactgtggaaatattaaaataaaaagtcacgttataatgcttgaagatagtttaaatcatgttcttgcaaaagacgtagtatcaaaagtaaatattcctgaaagtgatatagcacaaatcgacgggtatgccataaatcacgaaggattatatggagttgattattacgaacctatacgttttgatatagtaaatgaaaatgaaataaatttaacacaaataaagaaagtttcaaaaggagataagcttcctcttggagcagacagtgttattgatataaagtatgttaaagaatacggaagttatgtaacaataaacagacccataaacaaaaatagcggtgtttgtcttaaaggaagcacagtaaaagaaaatgatgtggtgctacgaaaaaatacacttttaaacagttttcatataggacttcttgcgagtttaaatgaatttatggttgaagtttataaaaaggttaaggtaggaattatctctaccggaaataacattattagagtaagagataaagacataaacaaagatatagacatatgctcttatattttgctttcggaacttgaaaagaaaagatgtgttggaatttcttatggaatatataaaaatgcccataaggaagttcttgataaagctacaaaagaatgtgatattgtaattatacttaattacgataaaaataaatttttcttagaaagtggaaaatgctattttgaagatattttgatttctccttcaaaaaatgctttgatatacaatataaattccacttttgtttacgtgtttgactcaatgcctaaagatgtacttataggatttagggagcttgtaaatcctgtaatgaattatatgcttgatattaaagacagtgaaggttatatagatgcaataagcctttataatattcctgcaagaaagggaattaacgagtatgtttttgttaaaataatggaagaaaaagacgaaacatattttgaagccattgactttgatgcatcttacagtgaggtaatgcgagatgcaaatggatatatagaaatatctaaaaacaaagataaaattgaaaaggacgaaaccgtaaaggttacgcttttatagaggtataagtatggattgttataaagatatttcttttgaacagatgcaggaggttttccttggattattaaaagaaacaaagcatcttcaaagtgagtatgtagatgtatatgattcttttaacagagttttatttgataatgtttatgcaaaggaagatgtaccgagttattcttattctttatatgacggtgtagcggtaaacataaaagatattgaaaagaaagaaaacctatataaaataagggaatacaagaaagtaaataaaggtgattttgttgatgataaatataatattgtaatagataagcacgatattatatataaaggaaatcttatttatgtaaattatatgcctaaccttttttatggtataaagtttaaaggtcaggaaagacaaaagggcagttatttatatgcaaaagacactcttttagacagtgaaaaaataggggttcttttggaagctagagttgataaggtaagtgtttataaaaaacttaaaataggatttgtgcttactttaaatgaagaaaagtacaaacatgaaaaaagaaaacacaatcctgaaaccatctttatggttttaaaaaacaaaatacaaaacgaaagagtacaaataaatttatatcctcatgaaagagaagataaaagagattttgaaaagagggtaaaggaagcttctttaaaaaatgatttggttattgtaatcggaagaaccggagaaggaagcaatgaccatacttatgaagttatagataaattgggaagtgtatatataaaaggaatgaatacaatacccgctactaactttatgtatggaaaagttttgggatgtgatgtgtttgctttccctggagatatattttcaaatatattcctttataatatgtttataaaaaaatacatatctttgcttacaagggtaggagaagaaaaagaaaataccattatggcaaagcttatggaagatgtggattcaagtttttattataaagaatttgtatatgtaaatttatttaacaattccgacggttttaaagctcttcctcttcaagtgaaaaatgcttcaatgtatgacttttttggttcagacggatattttgtgataaacgaaaatgtaaaaaacataaaaaaaggagaggacataaaggttcatttatttaagcctttaaaggatacggataataacgtgttgtttgtgggaagaaagaatttaataaattctaaaataatagaatattcttcttttgacaaaatgaatataattcaaagttcaaatgtaaatgaattaaagggcagtattacatcaaaagaatatgtgcttggagaatttgaaggaaaaagcgagcattttaaagatgagcttataaaaggaaaagttataattcaaggtgtaagggaaagatatggttttgccataaacaaaaaataccttgaaataaccgatgttgaagatttggctaaaaagaatatagtttttggaaatcttccgagaaatgatttttccagaaaaatacttgaaaccttacttaaaaacaaaaaaataaactataaggatataaagggttttgaggataatatatataaaaatgaaacggtattgttgtcagctttgttatcagacaggtttgatgtgtgctttataagtgagacagctgcaaaaaataataaaataaaatttgttccaataataacaaaagaaaatgattttgtgataaataccgtggatgaagaattagtcaaaagaatagcttttgtattttcaaatccgactttgaaagaagatcttggggaagattataatacagaaaattttggcagtatattaagaaaaaagaaataacggaagaaggaaaattatggatgtaaaagaaaaatctcttaaacttcatgaacagttaaacgggaaacttgaagttataagcaaaaaagaagtaaaaacaaacgaagatttatcacttttatatacaccgggcgttgctcagccttgtgtagagatacatgaaaatgaagatgacgtatataaatatacggttaagaaaaatcttgtaggtgtagtaagtgatggaacagcggttttaggtcttggtgatataggtgctaaagctgcaattcccgtaatggagggaaaggctatcttatttaaagagtttggcggtgttgatgctttccctatttgcgtggattcaaaggatgttgatgaaatagtaaaaaccgtaaaacttatttcgcctgtttttggaggaattaaccttgaggatatatctgctccaagatgtgttgaaatagaaaacagattaaaagaagaacttgatattcctgtatttcatgatgaccaacacggaacagccattgtagttggggcaggaataacaaatgctttaaaaatagtaaaaaaagatatagataaaataaaaattgttgtaaatggagatggttcggcgggatatgccataacaaaaatgcttataaatttaggtgcaaaaaatgttgtggtatgcggtattaacggtgctttaaaagaaggcagagatgacaattatgttcaaagagaacttttaaaaataacaaatccaaataaagaagagggacttttaaaagacgttataaagaatgcagatgtctttataggagtttcaaagggaaatcttgttgatgaagaaatggtaagaagcatgagtgaagatgcaattatttttgccatggcaaatcctgtgcctgaaattatgcctgacgttgcaaaaaaaggcggggcaagagttgttggaacgggaagaagcgattttgaaaatcaagtaaataacgttcttgcattccctggaatatttaaaggtgctcttggtgcatatgcaacaaagattacagaaggtatgaaagttgaagctacatatgccattgcaaactttataaaagaagatgagttaaacgaacataatatacttcctagtgcacttgataaaaatgttgctgatgcagttgcaaaagcggtatacgatcaagcaatcaaagagggagtagttaaaaatatcaaataaaactattttggaggataaagtgaaagatcagttactaaatatacaaaacgaagcaaaagaaaaaatacaaaatcttcattcattggaagatttagaaaaattcagaattgaatttatgggtaaaaaaggaaaacttacggcaatacttagaggaatgggaggattaagtaaagaagaaagacctataataggtaaacttgcaaacgaagtaagagaagccatagaatcagagcttggaaaaatgaaaacaagcattgaagaaaaaatcttacttgaaaaacttgaaaaagataaaatagatattactcttcctggtaaggaagtagaagtgggacatcatcatcctctatataatatcataggagaacttgaagaaatctttgcatctcttggtttttctgttgcagaaggtcctgaaatagaacttgtaagatataactttgataacttaaacgttcctcttgaccattcatcaagagataaaagcgatactttctatataaatgatgaagtttgccttagaacacaaacttcacctgttcaaattagagcaatgaaagcaaaagatgttccaatcaaggttattgctccaggaaaagtttatagaacagatgaaattgatgcaactcattcacctttgttccaccaaatagaaggtttaattgtagataaagggattacaatggcagaccttaagggaacacttgaatatgttgtaaaaagactttacggagaagaaacaaaaacaagattcagaccacatcaattttactttacggaaccaagtgccgaaatggacgcaacttgcatagcttgtcacggaaagggatgtaatgtttgcaaaggttcaggatttattgaaattttaggctgcggaatggttcatccaaacgtactaaaagcctgtggaatagaccctgatgtatataccggttttgctttcggaatgggacttgacagaatgactatgcttaaatacggtattaaagatttaagattattatttgcaaacgatactgagttattaactcaattttaaggaggacttggaatgttattacctataaactggttaaaagaatatgtaaatgtagataaagatataaatgaatttgccgaaatgatgactgtaagcggttctatggttgaaaccgtaacttatcttggagaaggaattgaaggtgttataacagcgaaaattaaagatattaaaccacatgaagatgcggaaaaattagttatatgcacaatgtttgacggaagcgaagaatatcaagttgttacaggggctaaaaatgtaaaagtcggagatattgttccttatgcaaaagttggtgcaaaacttccaaatggaatgactcttaaaaaagcaaaattaagaggagttgaatcttacggtatgctttgttcaggtgctgaacttggcatgagttcaagcattgttccaaaacatttggaagatgggatttatattttctctgaagacgtacctttaggagaagatgcaaaaaaagtattgggtcttgatgaatatgtaattgattttgaacttacaaataacagacaagattgtaacagtattttaggtatggcttatgaagcaggtgcaacacttggtaaaaaatttgttatgcctgattttaaaatcgaagataaagctaatgatattaatgataaattaagcgttgaagtaaaaaatacagacttatgtaaaagatactgtgcaagaatgcttaaagttaaaaaagttgaacaatcaccactttggatgcaacaaagattaatggcttgtggtattagacctatatcaaatatcgttgacgtttctaactatgttatgttagaacttggtcaaccacttcatatgtttgattatgataaattagaaggacataaaatcattgttgacactgcgaaaaacggtgaaaaaatggttactcttgacaacatagaaagagatcttgatgataaaatgctacttatcaatgatgcaaaaaaaggtgtttgtgtagcaggggttatgggtgctttaaactcagttgtagatgatgatacaaaaaatatcgtaatagaatctgcaaacttcaacaaaaactcaataagaagaacatcaagagtatttggacttagaagtgaagcttcagcacattatgaaaagggaattaatcctttgattacaagatatgcaatagacagagcagcatcattacttgttgaaatcggtgcttgtgaacttgtagaaggcttaattgatgaaaacttctatgaaaaagaacctgtaaaaatggatattgattcaaaagatgttaacagaattttaggaagcgatatttcagtagaagaacaagcaagacttcttgatttactaaactttgaaccaaaagtaaacggggatataataagcattactgctcctattttaagagatgacataaacataaaagaagatgttgttgaagaaatcgcaagaatgtatggatacaacaatattccaagtacacttatggaaacatcaaattatataagtgaaaagaatgtttactatagtgataaaaacaaaattaaggaagcattaattgcaataggaggacttgaaactcttacttatacatttacatcaaaagaaaaacttgatgaactcggatttgaagataaagatattagaagcaaatatgtaaaagtaataaatcctcttggggaagatacaggatacatgagaacttctatgatgataagcatgcttgagtcattatcatttaactacagcagaaagaataaagaaagagttttatttgagataggtaatgtattctttgatgctaaatatgatgaattaggactacctttacaagaagaaaaacttgttattggtaaatacaatacagattattttgaaattaaaggaattgttgaatatattttcaacaaatttagaattaaaaacgttaaattcacaaaagcagaagaaaagatgcttcaccctacaagaagcgcttacatttcagtaaatgataaagtaatcggttatgtaggaaacgttcatcctcttttacttaagaaatacaacttaaaagaagatgttgttgttgctgaaattgacgtaaaaacaatcacagaaaattacgacaaagaaatcgaatttaaacaacttgcaaaattcccatctcttcaaagagatattgcagttgtagttgatgaagatatttatgcaggtgaaatccttgatgaaattaagaaagcaggcggagaatatcttgtatcaagtgaagtatttgacgtatttacaggaaaacaagtaggcgaaggtaaaaaatccgtagctgtaagccttgaatttagagctgaagacagaacattaacagatgaagaaatagacgtaagattcgataatattgtaaaagctctatcagaaacattaaatgcaaaattaagataaaaaaagcacttttaaagtgcttttttatttttcttttaatatgaaaccttttggagcttttttagttgtttcttttgagtaaatgtttagatatatttttttatattctttattgtcttttgtatatgtaataaattcgtctattaagtagtcacttgactctatttcaaaacttcctgttcttttataataaagttccatattagaatcggttttaagtctgtctaaataatcatatgcttcatttattcccttacatggaataggggaatttatatctaaaccgaaattttcatcttcttgattataattttcataatctccgccattcatggattcttctaaaatttcaggtattgcacttataatctttaaatctttgtttgtatcaataaaaaaagtgttatccattgtatttaatatacaataattaactaccatttccatttgtatttctttgtctttataaatggttttgttattttcatcaaattttaaatgatttttagcttcctcttcctttatatcttctatttcatttaaaatatctatatctaaatcttcaatcaaatcataattggcaagttttatcttttcttctatatattttctatttgacttatcaaccatatctcccaaaattctaagcattattcctcttttatcatctgtataaacatacccaataaaacgttcttcaatatcatgaattcccatttttaaaagaaatttatcggcattatttaccgatacaaattttccgtcaatatctctgtaactacaatctctaattttcattaaaaaataacctcaaataattttatatatacatgataatatttttttaataattttaaatataaaacttaactttgactacaaaaaacctctctcttatttaagagagaggtctataggatgaaagataaaaactaaatgtaaaataaactatttatcttcgtttttctttttcataaaagctctgatttttaatggaagtccataaagtttaataaatcctgctgcatcattatggtcatataattcacctgtttcaaatgaagcaatttcttcattgtataatgaatatggactttcaataccttttgtaatcatattacctttatataatcttagagaaactttacctgtaacagtttcttgtgttttatcaacaaaagcatctaatgcttctctaagtggagagaaccacattcctgaatatacaagatcagcatatttaactgctactgttctcttatatgcttgagtttctctatctaaagcaagttgttcaagttcattgtgagcataatataaaattgttccgcccggagtttcatatatacctcttgacttcatacctacaaccctgttttcaaccatatctacaacaccaataccatgttttccgccaagttcgtttaattttgcaaggaggctaacaccatccatttcttctccgtttaatttaacaggaatacctttttcaaattcaatttcaatttcttctgcttcatctggagcatcttctacatatgttgttttttgaagaaggtttctgtaatcaggcatgtttgcaggatcttcgagttccaatccttcatgagataaatgccaaatattcatatctcttgaataactttcttctgctgacatattaagtttaatatcatgtttaatacagtaatcaagagcatcttgtcttgatttaatactccaaagtctccaaggagcaatgattttaatatcaggagctaaagccataattgtaagttcaaaacgaacttgatcgtttcctttacctgtagcaccatgacaaatacaatttgcaccaagttctcttgctttatcaaccaaaatcttagaaattaatggtcttgcaatagatgtaccaagtaaatatttgttttcataaactccgcctgattttaacattgggaaaatataatcatttacaagttcttcagttgcgtcaattatatcaatactatctgcaccatattcaatggctctttttgctaaatcttctttttcatttggatctacttgtccaacatcaacacatactgcatgaacttcacaatcataattatttttaagccaaggaactattgttgaagtatctagtccacctgaataagctaatactattttatctttcattatatatatacctccaaaataaatcactaatttaaaatactgactaattatacataaaaatgtataattagtcaacaataaaaggaaaattttttatatttttttatttttatacatttttattaaaaattttgcatattatattcactcgttttccaaattttgatatacacaaaatatcttttaggttgatatttttataatttaatcatataatatatatgaccttaaaattatgctattattttgaacctacacttttacacagggatatcgggtctttaagtagatgtcaagcctctataagtggacggcagaagcggtaagcagataacccacctatcatttttgataggatcaaaatcttggcaattttagggtcttttttattttaaggggtacaaaatatggatttaatggaaatattaacaaataaacaaggttataattcaaaccattcaaatgaacttgcaaaaattcaacaaaaagctaaaatgttatgttttgaatataataatacttctccaatagaagaagacaaaagaaaagaaattctaaaaaatttacttggaacatataatcctcttgtttttatagagccttcttttcactgtgattatggattcaatatacatatgcatgggctagctgtaataaactataactgtgtaatacttgatacctctcctgtaaatattggtaaaaatgcatttattgctccgggtgtatgtattgcatgttcaggtcatgcaatagataaaacccaaagagcaaaaggagttggaacatccaaacctataacaatagaagatgatgtatggataggtgcaaattctacaatttgtgcaggtgtaactataggacaaggaagtgtaattgctgcgggaagtgtagtaaataaaaatataccaaaaggtgttgttgtcggaggagtgccttgcaaggtaatcagagaaataacaaaagatgatgtaatagaaaatattattttttaaataaaacacttgacttttgaaattagaatgattataatttagctacaaacaaaaaaaggagataagaacaatgttagataaaaaagttgctgaattattaaacgatcaaataaataaagaattatactctgcttatatctatttagatatggcaaacttctatgctgattacggtttagatggatttgaaaactggttttatatccaagctcaagaagaaagagatcatgcaatgatgatcagagaatatttaaaagataacggtcataaaatcacaagtgaagccattgaaaaacctgaatacacatatgaaaaaccaatggatccacttgtaaaaacattacaacatgaaaaaatcgtaacaggtttaataaataatatatatgatgctgcatacgaaatcaaagattacagaacaatgaagttcttagattggtttgtatcagaacaaatggaagaagaaaaaagcgctgaagataatataagaaaatttgaattatttggtcatgatgctaaagggttatactctcttgaccaagaatttctaggtagaacatattcagctccaacaactgctgaataataaaagaagcaccataaggtgcttttttttatatgtatttatatatgtaacgctaaatctaaatatcttttctttattttaagctgcttcgctctaaatttaaaatatcttttatacatatttactaatttgtcatttataacttgattttcattcttttttagttcaacccttatatttaaatacatattatcccctattctttcaaacatttttaccatataaaacataacaaataatttcatctttttcatttcttttacctcttttcttttttcttgacattattatatattttctaaacatcaaaatttgtcgaaaaatacaactataaaggttaattttattaaaaatagtatattttaaaataatggctaattaattgtataacgttgtatttataatataaattttgtataatactatcataacaaccaaaagtattaatttaattatatatgttaaatagcactaataattacataaaggattttaaaatgaaactaaattatacacatattggacaaacaataaaaagttatagaaaaaataaacatattacacaaaaagaattatctaagttaataaataaatccgttactcatataagtaaaatagaacaaggtcaaagcaaagcatctcttcaaactatagttgacattgcaaatacacttgaaataaccgtagatgaaattttaaaaggaagtataataaaaacagctcaaaacgaaatgataaaagaatatgaagaaatatttaaaaactgcacatttgcagaacaaaaatttttaatagaaaatttaaaatttgccaaatatcaattaaaagaattaaacaatacaaaataaaaaagacttaatatattaagtcttttttattcacttcttaaagttattaaattcatttcaaaagggttaaatattctaaaattaacagtgtcatttccgagtccggcacttacaatcatatttgtatcattaattgtatataatccatggtaatattttggaaaccattcttgatcaggagataaaagtccacctttaaaaggtattcttattattcccccatgaacatgtccggataaaatcaaatcgacaccgcttttttcgtatacttcaaaataaataggattatgagttaataaaatattatatttattattttcaaatgtttctttatttatagtctttgaaaaattatcttcagtatattctatatttgattcttttaaagctgcctttgtagaataatatactaaatctacattaagcccgtacatatttatatatgatgaacctttttgaagttttatcttggtattttttacaactttaacatcaagctcttttagtgaagatataaattcatcataaacaccaacattattatattcaacaagctgttcatgatttccatctatataataaacaggataatcttttgatattttttttaccaaatttataaaaacatgaccatcatcctctgtggaattcatcatatctcccgtacaaactataatatcaggatcgattttataaattttatttataagttttatattattttctccaaattctctcgaatgcaagtcagaaagctgaagaattttatatccatcaaaattactgtctatcttatttgaaacaatttcattcttttgaactataaataaagaggtattttcaaaatataaatatacaaaaagtataagaacaatcaatagagtaactattttaaattttctcaaaataaaacctccatatatagtgtattgtttattatatcacaatatgttttttaaccaaaaggaaaatagtgtttttaataaataaatttatatgatataattagcatacataatttacgtacataatttttatagaggtgcatatgaaaaaagaagatttaaaagatataaaacttttcgttatggatatggacggaacaatctacttaagttcaactcttatagaaggttctcttgactttattgaacatttaagaaagaacaataaaggtgttttatttttcacaaacaattcttcaagaacaggagaaacttatgtagaaagacttaacaatatgggatttaatgttaccgataaagatgttatgacatcaggagacgtaacaataaaatatctaaatacaaaatataaagataaaaaagtatacttagttgctacacctaaagtaacaaagagttttaaagatgcaggaattaatcttgttgaggaagatccagacatagtagttatgactttcgatactactttaacttatgagaaactcgataaagcatgccattatataagaaacggagctttattccttgcaacacatcttgacataaactgtcctacaataaacggttttatgcctgactgcggtgctatgtgcgagcttataacaaaatctacagagaaaaaacctaaatatcttggaaaaccatttaaagaaactgtagatatgatagttgaaagtaccggatataaaagagaagaaattgcatttataggtgatagaatttatactgacgttgcaaccggagtaaataatggagcaaaaggaatccttgttctaagtggagaaacaaaaaaagaagatatacctaagtttgatactaccccagacttaatatttgataaagcgtatgatatgattccatatataaaataaaaaaacgtttgatatcattttgtattatgatatcaaacgttttttattcttctatggcatttaaaaacatttcatgaaattcctcagaaaccttttttaaattaataattttattattcattaaaaaacagtgtttgctgcttccagtattaacaacttctcctgtttctttatttgtaagagtatattcaagttcaagtctaataccgttgtatttctttattttaacatttaccaaaaccacatcatcaaaataaaccatattcttatattcactgcttacactaagaacaggagaaattatccccttttcttccatttttttataacttattccaagttcgttcataaaatatatccttgcactttcataccatcttatataatttgaatgatgaataatacccatttgatctgtttcataatattcagctttatgttcgtaaactttcatttttacctctttgtttataaaataaattacatttatattctatcataaaacattaaataaaggattattttttaattttatggtaataaatttatataaataaaaatatgaaaaaaatttcataaaaaatgaaaaaaaaagcttgcatttaataacttttcatgtataatataaaaggactgttaataaggccccttggtcaagcggttaagacgtcgccctttcacggcgaaaacaggagttcgattctcctaggggtcaccaaagtctttttaattttacggctcggtagttcagctggttagaatgctagcctgtcacgctagaggtcgagggttcgagtcccttccgagtcgccattttacatgggggagtgcccgagtggctaaagggggcggactgtaaatccgttggctcagcctacaatggttcgaatccattctcccccaccatcctcataattgataattaaaagtgtacgatgtacactttttttttaattttaaaattttcataaaaacagatgtataattttaaaatattattaatatgtttttttattaaattattatctaattgatcaaataatgataacctcaaaattaaaatgtctcataaccttatacataatatatttttctaataataagaaatattgttgcaattagaataaatattaactatagtgtttaatctaaagaattattttttatatgcaaataaaaacaaaagatttcatcattaaaatttcagttataaattatttttattaaacccaacattttttattatatataatatgaaaataaatcattgctataaaaaaatttttaatatataatatacaagtttattgaatataaaaattatttataggcaggtaaaatatgacaacacagcaaattatttcaatagtaatctttttaattacaatgacagcaattatgacagaaaaagtacatcgtactgttgcagcaattacaggtgcaatacttctcattgttacacatattttaacaatagaaacaagcatagcttatgtagatataaatacggtcggtgtattagttggcatgatgctttttgtcgcagtggtaaaaaattcaggtatatttgaatacatagcaataaaatcagcgaaaattgcaaaaggaaaaccggtaaatataatgattatattcattttaataactactattttgtcagcatttttagacaacgtaactaccgttcttttaattggtccaatgacaatagcaataacaagaatattaaaaatcaatccggtaccattccttattactcagattatggcatctaacataggcggtacagcaacactaatcggggaccctccaaacataatgattggaagtgccgcaaatttaggttttacagattttatattaaatacaggtattcctgtaatattcattattattacagcaataatatattttcttatactttataaaaaacaactcgctgttgatgaagaaaatatacttaaggtaatggaaatggatgaaaacaaggccataaaggataaatctttaatgataaaaagtattattcttattgttcttgttgtaattggatttgttttccattccaatcttcaaatggagtcttgtgtaattgcacttcttgctgctataattatgttacttataggaaaacaagatgcggaagaaataatccttggagtagaatggtcaacaatacttttctttattgggctttttatagtagtaggaggtcttgaagaaaccggagttattgggcaattggctaatttactggtatctgctacaagcggaaatatggttttaaccatgataataatagtttgggcttctgcaatcatttcatcattcctcgataatataccttttgttgcaactttaataccattaattctaacaatgcagcaaacaggaaatattgacgtaacaccactatggtgggcattgtctttaggtgcttgtcttggaggaaacggaacattaatcggagcttccgcaaacgttgtattatctagcataagcaataaaaacggttatcctataacatttaaacattattttaaaataggattccctttaatgatcatatcaataataatatcatcaatatatttattaataagattctaataaacagaaaggagatataatatgaataggaattcggtaagcggagatataatagactttagtctaaaacagcttggagcaaaaataagcaagttcaacagtcaaatgcatttggtcgaatttgatataaatgaaaaatgcatagtttcttatatctttactattacaaaagaagataaattttatctacaaagactaaaaccatatccattatgggaagaaaaatatgcgaacgttgatgaaatagttaaatttatagaaagagatatcgcaaaatttaaaaatgcagcaaacagcaataatttcgataaatttatagaaattgcacaaagcagcgtttttatttcacagtatttggaaaacttatttttaaactataatatagatagagaaatgcttgataatattgaagtaggcattaaagagataatggaagtaattcaaatgcataattctgaagaagcttatgaaaaaatagaagtaaaacttaaatagaaataaaaaagacagtatatactgtcttttttaatatatagaaatacccataaaaaatctaaaaaaggcaagtaaagtcaaatgaataggataaaacaaataaaaaagatattttatatttaattttccttttaatccattatacatattaataataaaaagagaaaaaacacttatgcaaaaaaagttttttgaactataaataagtaaaactcctgacaataaaaacatcattgatttatcatttctaaataaataaaatattgctattaataaaataccgatataatcataatccagacaaagatagtaactaaaaatacaaaaaacaaatactattatcccctgtttgaacatttctccgctgtttttacttaaagctccaagcatcaataccgcaagagcaaattcaaacaaaacattttgatatcccaaataaaaaaatgaattatgaaatgctaaatcaaaaggaatttcagaaataaaagcaaatattaatattcttataaaatatctctttatgctctttgtatgtaaaaacccttcaacaataaaataacaaaacaaagggaaagatattcttcctataaatcttaaagcataatcaatattaaaccaaaatagagcatctcttccccaaaatacactaaaatttaatatgccattttctattaaaacccctccaatatgatctataagcattaatattaaagcaataattttaatctgatttgaattcaagcaatctttcattgttatcaccttaataaataataccacaaaaataaagatatcaataaaaaaaagcactacagagtagtgctttatctgcttttgactattaacttaattcccgttctgtcactgccgttgatttcaacttccgtaaatgcaggaatacaaacaagatcatgtccccccggagcaacatatcctctggcaatggctatagcttttatcgcttggtttaatgctcctgctccaattgcctgaacctctgcctgatcactttctctgattactcctgcaagcgcccccgcaacagaattagggtttgagccggatgatactttcaatacttccataatgtttcctcctataatataagttataaataagttaatttcttcattaattaatatgtaataaaacttgtattattcccataattaatgaattttataatgactttctttaaatattactatgaaaatctaaaatcataatatcataactatttatagaacttttgtgctttttgtcgaagaaattaatataaaaagaataataaatttcaataattttctaaatatttttattatttcggaaattattgtttgtaattttcagaaaattctgatataatatgcgggtatactttaatttactatatataaaggagataaaatatgaataactgtgtagaaataagatggcacggaagaggcggtcaaggagcaaaaactgcagctttgttacttgccgatgttgccttccaaacaggaaaatatgtacaaggtttccctgaatacggaccagaacgtatgggagcaccaataactgcatataaccgtataagcgatactcctgtaagagtgcattcaaatatatatacaccacaattcgtggtagttgtagacgaaagtttacttgacagcgttgatgtaacaaaaggacttaaagaagacggtgctatagtaataaatacaacaaaagataaagaagaaataaaacaccttctaaatgattataaaggcggtatctatacaatagacgcaaaaaaagtttcaatgtcttgtcttggaaaatactttccaaactctccaatgcttgcagcaatagttaaagtatcaaaaataatggatgaagatttatttttaaaagaaatgaaagcatcttttgaacataaattcgcaaacaaacatgaagttgtaagcggaaacatgaaagctcttaaaatggcattaagggaggtaagataatatggctgatataaaaaaattaagtaaaaaacccgcatggcacgaacttacaacagcaatgacaatagatgaaggcggtacttctaaattatttaatacaggagaatggacaagtgtaaaacctaaagtaatcgaagaagaatgcagacaatgtcttttatgtgcacaagcttgtcccgacagtgcaataccaattgcccataatcacagagtagcagttgatataaatcactgtaaaggttgtggagtatgcgtaaaaatttgcccatttggtgcaataaaaatggaaggagtaaaataatgacaaaaaaagacagattatcaggaaacgaagcggctgcatatgccctaaaacaaattaatccggatgtattccctgcattcccaattactccatctacagaaatacctcaatattttgcatcatttgtagctaatggaaaagttaatacagaatttataacagttgaaagtgaacattcttctatgagtgcagcagtaggagcggaagctgccggagcaagaagcgttacggcaacatcatcttgcggacttgcttatatgtgggaagagttatatgttgcagcatcagacagacttcctattttacttacacttgtaaacagagccttatcaggacctataaacataaactgtgaccactccgacagcatgggagcaagagattcaggctggattcaaatatattctgaaaataatcaagaagcatacgacaatataattcaagcctaccctattgcagaaaataaagatgtattacttcctataatgatttgtcaagacggatttataacatcacacgcagttgaaaatatagaacttttagacgataaagacgttaaagattttgtaggcgaatatgaacctgaaaattatcttttaaatcctaaaaaatcttttgcaattggagcttattcagtaactgattattatatggaagcaaaagttgcacaagcaaatgcaatgaaaaatgcaaaacaagttatacttgacattgcagaaaagtttgaaaaaatttcaggaagaaaatacggactttttgaagaatataaattagatgatgctgattatgcagtagtaatcattggttctgcagcaggaacaacaaaagatacaatagataaaatgagaaaagagggcaaaaaagtgggacttttaaaagtaagagtattcagacctttccctggagaagaaattgcacaggctcttaaagacgtaaaagccgttgcaataatggatagagctgaaagctttagttctcaaggaggtcctcttggaagcgaagttatgtcttctctttataaagcaaataataattgcaaagcagtaaactatatttatggtcttggaggaagagacgttactgtagacgatatggaaaatgtatttaacgaacttgaaaatatacataaatctaatgaaaaatacgacacatacagatttatgggtgtaagagaatagaggtggcagtatgagttataattttaaagaaataatgagcagacctgaacgtttagcaccgggacacagaatgtgtgcaggatgtggaggaacaattacagtaagaaacgtactaagagggttaaaacctgaagataaagccgtaataggaaatgccaccagctgtatggaagtatcaacatttatatatccttatacatcttggaaagacagttatatacataacgcttttgaaaacgcagctgcaactataagcggtgttgaaggtgcatataaggcattaaaaagaaaaggaaaacttaaaaaagatccaaattttaaatttattgtattcggtggagatggaggtacatacgatataggacttcaatctctatcaggagcagttgaacgtaaccatgactttacttacgtttgctatgataacggtgcttatatgaacaccggtatccaacgttcttcagctactccaatgtacgccgatacaacaacaacacctgttggtaaaaaaagtaacggaaaacttcaaaacagaaaagaccttacagaaataatggttgcacataatgctccatatgttgcacaaacaacatttgtacaaaactttagagatttacatttaaaagccgaaaaagcaatatatacaaaaggtgcaacattcctaaatgtaatgtctccttgtccaagaggttggagatataatacttctgatattattgaaatatgcaacttagcagtagaaacatgttactggccactatttgaagtaataaacggagaatggatacttaactatgaaccaaagaaaaaacttcctattgaagattttttaagaccacaaggaagatttaaacatctattcaaaaaaggaaacgaagatttaattgaacaattccaaaaagaagtagataagcgctgggaaaaccttttaaaaaaatgcaaataacaaccataataaaaagtacagactataaataaagtctgtacttttttataaaaaaaacggcatagttgccgttttaatcatatattttataaattctttctacatttgtgcatttaaaagtcgtatcatcaaaagtaaacacggctccatttatctgtctttttcccattgcaagagcatatttacccgttggtctttgcgctctaaatttcttcacaataaattctctgtctacacctataaccccgtcaacacttccgcacattccaacatctgttatataacccgtcccattttctaaaaccatattatcggcagtttgaacatgagtatgggttccatatacaccggaaaatcttccatcaacaaaatatcccattgcaattttctcacttgttgcttccgcatgaaaatcaagcattataatatcgcatatattttttatttcttcatatattttatctgcaacatcaaaaggattatcaagaggatttaaataagtagttccagataaatttacaacccctaccctcacttttccaactctatacacttcatatcctcttccagggcaaggagaaggataatttgcaggtcttatcattctatcttcttcttgaataaaattatatacatctttattatcccaaatgtgatttcccgatgttataacatcaataccacaacttctaagttcgttatatacttttcttgttattccttttccgttagccgaattttctccgtttgcaattacaaaatccgctttatattctgctttaatatcagaaagctcatcaacgatgagctttcttccatatttagcgaatatatcaccaaatactaaaatcttcaatttttacctctttaactattttgcatattctgttgctcttgtttctcttattatgcttactttgatatgacctggatattcaagatcattttcaaccatatttgctatttcttttgcaacatgaaccatttgtaaatcatctacttgttctggtttaaccataactctgatttctcttccggcttggattgcataagatttatcaacgccttcaaaagaatttgcaatttgttctaatttttcaagacgttttgtatagctttcaagtgtttctcttcttgctcccggtcttgccgcagaaatagcatcggcagcttgaaccaatacggcttcaacagttgccggttcaacatcaccatgatgagcttcaacagcatgaataacttctttgttttctttatatttctttaataaatcaacacctatagaaacatggcttccttcaacttcatggtcaattgctttacctatatcatgaagcatacctgctcttcttgcaagttttgcatttgcaccaagttcatctgccataattcccgctaagtttgcaacttcaatagaatgttttaatacattttgtccgtaacttgtacgataatgaagtctacctataagttttgttaaatcaggatgaagtttcataacgtttgtatcaaataacgcttgttcacccatttctctgatttttgtatcaatttctttttctgcttttttaattgtttcttcaattcttgcaggatgaattcttccatcaacaataagtctttcaagagaaattcttgcaatttctcttcttacaggatcaaatcctgaaagaataacagcttcaggagtatcatcaataatcaaatcaatacctgttaatgtttcaattgttcttatgtttcttccttctctaccgattattctacctttcatttcatcgttaggtaagttaacaacagaaacagtagtttccgcaacatgatcggcagcacatctttgaattgcataagatacaatttccatagcctttttatcagcttgttcctttgcttctaattccttatttttaataagtaatgcggtctctctggaaatttgcttttcaacatcagaaagaagtaattgtctggcttcttcaaatgttagttttgaaatcttttcaagctctttaatttgttcttgatgagttttttcaagtttatcttctttttttagaagctcttcatttttctttattaaagaagcttctttgtgatctaaagcatcgcttcttttgtcagccatttcttctctttgaagaactcttttttcaacaagttgaagttcttctcttctggctcttgcttctttgtcaaattcagtttttaaattaagcacttcgtcttttgcttcaataagcttttctttttttattctttcgccttcttttaaagcatcttcgaccatcttattggcagtttgttcggcatttctaagtttaccttcgccagatgtctgcttataatatccaccgatgaaaaagcaaattatcccaataacagctgctataattagcactactggaagtgataattccattttctcctccttattttaaattaataaataaaaatatttaattttaagtatgtaacgaaaatgaaccaaacaaaacaatactatgtttctggtattagagttaaaaatatataaaaatataaaattttaaatatatataaatactaaaaaagtttagtttattatcgtaatttaaacatactacctactaattttaatgttttttcactattaagtcaacaaaaaaataaaaaggtttttataaaattcataatattttttacaattttttactattaaaatattattatgattttatattttaataaaacacaaaatgcggtataatgtttagcacaaaaaggaggtaattttatgaaacaattccttaatgaatttaaagagtttgctttaagagggaatgtaatggatttagcagtcggtgttataatcgggggtgcttttcaagcaataataaactctcttgttaaagatataatctctcctattataggattatttgccagaacagatttttctgacatggttataacggtacttgatgttcaaattagatatggttcttttataactgccgtaataaactttttaataatggcatttattatctttgttatggtaaaaatgctaaataaattagcatcaatcgggaaaaaacaaaaagaagatgaagcaccaaaaacaaaaaaatgcccttattgcttaagtgaaatcccggtagaagccacaaaatgcgcacattgtacttctgatttaacagaataaattttataaaataaccctaaaaaatttattaaatttaaaactaaggagttaaaatgcatttaaaaaaaataaatacaaataattgggatagaaaagaatattttgtacattatttttctaatattccttgcacatatagtatgactataaaattagatattacaaaataaaatcaaaaaaaataaaattatatccaactatgctttactatataacaaatattgtaaataaacatgatgaatttaaaacaacatttaatgaaaataatgagctaggaatttatgatgaaatgataccttgctatacaatatttcataaagatacaaaaactttttcaaatatttggacaaggtatacatcaaatattaatgatttttatgctgaatatgaaaatgacttaaaacaatatggaaacaaaaaagaattaaatgcaaaacccaatactccaagtaacatatttaatgtatcaataataccttggacaacttttgaaagttttaatttaaaccttcaaaaaggttatacatatttatcccctatttttacattaggtaaatactacaaagaaaatgataaattcttaattccattatctatacaagttcaccatgcagtatgtgacggatttcatgtatgtcaatttttaaatgaattacaggatttaattaacaaataaaaatatacataaatcctttcaaacaataaaaaaagagctgaacgctctttttttattttgcagcttgagtatcagatacatatatttctcttgtttgtacatcttctttatttaactcaaaatcggttttatctttttgtataacaccaatataactttttccttcatatacaggaagttcatttccttcaagagtagtaatctttaaatcaccctcttcactgtcttttgaccacttaatttcttgaactctaccgtttgaaagataatatccgcttccgcctttccagtcaacttcttttaattctgcaacaccaagcataccaatttcagtttctaatataaacacatttgtaaattccaattgtttatttgttttcccatcaatttgatcttttccgctatgtttctttttatatgttttactttcactgtcaaatgtaaaagtagaataatattcattagagaaatttaatgtagctttgttgcaagcagtaagtttagttgtttcaataacttctttagcttcttcctcttcttttccaccaaataatttttcaaaaaatccgggttcttcctcaacaacttcctctttgacaataggttcaaaagcaaaaataggtttatctttttcttcttttaaatcagtccttatgttttctttatttaaaacttcaggaatattgccacctttcaaatatccggtatgctctaatgcataaccactatttaatctgtcttgatctctgtcaaataaatcagttccataagtcattccgtcaaatctatctatacctaaactatttaaggtatttgtagcataatcatttccaccccagtgaatatatatgctgtcaaaactattagcaaatatagggaaataatatctacagcttcttataggacaaacacttggtactttagtatagtcaccataaattgccataagtcttgttatatttccttctacaggaatttcaaaaataatatctgcatcccctattccatattgcggcaaagcttccttatgattgtttaccattatggcaataggtcgttttccaactgcttcttttgatatgccttcaagtcctgtaagtggattaacatctactttaacttcggcagtctcttcttttccacatccataaaatgttccaagaactaaaaatatgcatgttataattgcaataagtttcttattcataatatccaccccctatatacaaaaaattttatcataaaacttcttgttatgcaaacttttacatattttatatacttactatataattcttatttatataatttacattaaataagaaacttatgtattaacttaaaaaaattagctaaaaaagcattaataagaaacagataaaatagcattaaataaaataattaagaaatattatattttttgtaatacataatttaaaccccaaaataaatatataagttaaatattaaaaatataaaaaactgccctaaatgagcagttttttatgaatgtctccttttatatattttcaaagaagcaaaataacttattatcattaatacaatacctgctattaatcctattgaaagaatcatatgaacattattcattatataagatatataatcaactctccaagaagttgcaccataaaatcctgcaatcatcataataagaagtatatataaaacaacacctttcttatttccaagaagtacaaatataaagaaacttatagcattaaatataagtcctaccccaatggaaaacaagaatacacttaaagcagaagataaggaaatgcttttataaatatctacatatacataacatacaattaaatttaaaataaagcataaaccaagcattataaatccggtcaaatactttgaaaagattatttcttttttggtcattggataagtaagctgtattttatcaaaatcagttttttcatcttcttcaacagttacttgaaacaaagaagaaccaagcataggaagtgttataccacaaaaaagtaaaaaaccaaaatttgatctcataaaaagcataagcgcaacaataaataaaaaagcaaatataaaactaattaaattcttttttattccaaatcctaaataaaaatctttaaatattattcctttcattgtaccttttctcctttaatgtaaaataacataacatcttcaacacttgcattttctataatcaaatccttataaatattcataagctccattctgtttttaaccaaaactttatacgaaaaggcttcttttctataaaaaacaatatcatcagggcttaaactatcaaagaaatcttttttgcatgaaagaacaccgtaattatcatgtatgtcttcatattccttaataaactgtaatcttccttcgtgtataaaggctatataatctgatattttatcaagatcacttgtaatatgagaagaaattaatatgctgttttcttcattttccgtataacttctaagtaactccaaaatttcatctctaaatacagggtcaagcccacttgtggattcatcaagaattaaaaatttaggattatgagaaagtgccaaagcaaattcaagtttcattttcattccttttgagaatttctttattttcttattaacaggtagatcaaaattttcaagtaaagaataatatttttcattatcccaatttttatatatctttgaaagcatcttacctattaatttagcattcatatattcgctataatgacttttatcaaaaattaccgcaatatcttcttttatatctttttcatgttcattaatatttttattaaatattttcacttcacctttttcaggttcattaatatttaaaatcgaatttataaaagtagacttccctgcaccgttttcccctattaaaccaacaacactccctttaggtatttttagagaaatatcatcaagtttaaaatccttatattcttttgtaagattgtttacctcaagtacatattccataacttaaccctccttaaaaaacatatcaataagttttaaaagctgttcttttttaatatcattttcctttgatatatctacaacttcttcaatcatgctttcaacttttcttaaattttcttctctgataaaatcattattttgagctgaaacaaacgtacctctcccaacgcttgattctataaatccatctctttgcaaatcttcatatactctttgagatgttattacacttatatgaagttcttttgcaagttttctcatagaaggaagagaatctcccggttttaactctcctttaataatcattgcttttatctgagatgttatttgttcatatattggtttattactattattacttaaaataatttccacaaaatcatctcctttaaattgtacttatcttatgagtacattatatataataatatatatattgtcaatatataataagtacaattttattttattaataacattcttgaaaaaaatataaacataatgtattatttaagtcataaaaatcctgaaaggcagtaaacatggaattattaaaaaatagaatattaaaagatgcaacagttaaagaaggaaacgtactaaaagtagacagtttcttaaatcaccaaatggacataaatctaataaacgaaataggtaaagaatttaaaagaagatttaaagacaaaaaaataacaaaaatacttacaatagaagcatcaggaataggtattgcctgtattaccgcacagtattttggagtagatgtagtatttgccaaaaaagctcaaagtattaatatagacggagaagtatatcattcaaaagtaaaatcatttacccacaataagatctatgatgttatactttcaaagaaatttttagataaagatgaccacgtacttataatagacgattttcttgcaaatggctgcgcacttcttggacttattcaaattgtaaaagaagcaggagcaacaatagaaggtgcaggcatagtaattgaaaaaggaatgcaggaaggtggaaaaattattagagaaaagggaatcaaccttgaatctcttgcaataatcgattctatggataacggtgagatagtatttagataaaaacacgtaataacgtgtttttttattataaaattttttataattgggaaatatttccctatcttaccaaatagcataaaaaaatattgtcatattctacgataaactaaaatatatgatatacttaaaataatgaatattaacgggaggtatgtaaatgggtattaaattgggcttagatatcggtacatcatctgtgggcgttgcagttattgatgatgattataatgtaattgaagctgtatctgatatttttacagaagccgatgcaagcaagaatgttgaaagaagaggttttagacaaacaaaaagacttatacgaagaagacaaaatagaataagtgattttaaaggattatgggaaaaatataatcttgaaattccaaaagaaaaaataaacaatcaacttattttaaaaaataaaggattaaacgaaaaactaacacaaaatgaaatttattacgttcttttacattctttaaaacacagaggtattacttatctagatgatgctatagatgaaacaagtaaaagtaaatctgattatcaaaagggtattgaaataaatcaaaatgaactaaaaaacaaattcccttgtcaaattcaattagaaagattaaatactcttggtaaatatagaggagaaacaattgtaaaagaaaatgatgaaacaattacatttagcaatatctttacaaaatcatcttatagaaaagaaaatgaagaattcctaaataaacaaagtgaatttcatgattttattacaaaagcatttattgatgattatttaacaatatttgacagaaaaagagaatattatgtaggtcccggaaatgaaaaatcaagaacggattacggaagatacacaacaaaaaaagatgaaaatggaaactatattacagaagaaaatatatttgaaaaactaattggaaaatgtagtgtatatgaaaatgaaagaagagcagcaggggcatcttatacagcacaagaatttaacatattaaatgacctaaataatattacaataggaaatagaaaattaacaaaagaagaaaaaatcgaaattattaatactgttaaaacatcaaaaacagtgaatatgctaaaaataatagctaaagttactaatgaagatattaaaaccatgtttggttcaagagaagataaaaacggtaaacctgattttcataaatttgaacaatataacaaattaagaagaacacttgaagagcatgatatagatattaatgatttttctattgaaacattagataaattagccgaaattctaacaataaatacagaaaaagatggaattttaaatgcaataaaaaattctaatttaaattttagtgacgaattaatagaaatattaattgcttttagaaagaaaaactcttctcttttctcaaaatggcaatctttatctttaaaaatcatgaaagaattaattccgcaaatgtacgaagaacctaaaaatcaaatggaacttcttactgaaatgggatttttcaaaaaaaatagtgaaaaatttaaagaatataacaaaatacctaaggaagaaataacaaaagaaatatataatcctgtagtaaaaaaatctatatcaataacaattgatgctataaatgccgtaataaaaaaatatggatatcctgacgaaattgtcattgaaatgccaagagatagaaacagcgaggaagaaaagaaaaatattcaaaaaatgcaaaaagcaaatgaaaatgaaatgaagaagataaaggaaagattatttaaagagtataatattgatcttcaagacaaacattttcataaccataaaaaccttgcattaaaattaaagctttggaatgaacaagacggaagatgtatgtacagcggcgaatacataaatatagaagacttaatatatgattattctaaatttgaaattgaccatataattccaaaatcaatatcatttgacgacagcagaagcaataaagtattggtatacagaagagaaaaccaactaaaaggaaacactacaccttatatgtatctaaaagatatagacagaaaatggaattttgatgaattcatgagttatgctcttgatttaaaagatagaaatcttataaataagaataaacttaaaaatcttttatttacagaagatattacaaaaattgaagttttaaaaggatttatacaaagaaacatcaatgatacaagatatgcttcaagagtagttctaaattctttacaaaactatttcaaatcaaaaaacaaagacacaaaaataagtgtaataagaggaagcttcactcatcaaatgagagataagttaaaacttaaaaaagacagagatgagagttattctcatcatgcagtggatgcaatgcttatttgttattcaaaaatgggatataatgcataccataaattccaagaaaactttattgactttgagcataatgaaataaaagataaaatgcaatggattgccggaataaaagatgaaaaattagacgatataatgtatgaaaagaaatggaatataataagaaataacatcttaaaagcagaaaaagaagttaaattctggcataaagtggataaaaaagcaaacagaggtttatgtaatcaaacaataagaggaacaagaaactacgatgaaaaaacatataaaataaacaaaatcaatatccttacagatgatggatttaaaacatttaaaacgaaaatacaaaaaggaaaagaaagtgatttcttaatgtacagaaatgacaaaaaaacttttgatattttattaaaaatatttaacgaatataaagactgtaagaatccttttgttgaatatgaaaaagaaacgggagattatataagaaaatattcaaaaaaaggaaatggagcaagaatacaaattttaaaatatcttgatggagaagttggttcttgtattgatgtttcccataaatacggtcataaaaaaggaagcaaaaaagttatccttgaaagcttaaatccatacagaacagatgtttattataacgaagaaaagaaagaatattatttaatcggagtaaaatatgccgattgtagatgtatagacgggaaatattttatagataaagaaaaatacaatattgctttaagaaacgaaaaaataataaaagaaaatcaaagcatggaagatttaaaagctcttggatggaaatataaattttcactatataaaaacgattttatcgaatacgaaaaagatggagaaatctttactgaaagattcctttcaagaaccatgccaagaaaaaaaaattatatagaaacaaaaccaactttcgcacctaagtttgacaaaccacaaaaacaaattggattaagcaaaacaaagatgataaaaaaaataagagtggatattcttggaaacagatattatgcaaaagacgaagatttcactttggatattgacatttattaaaaatgaatatataatgttattgtagatttttacaataactcaatttattcagatctactaaaataaggctttatgccgaactcaaggacgtcttcggacgtccttttttattatattttaaggagaaaacaatggcatttagagtgcttttaatagaaaacgaagtaaatataaaattaaacttagataatctcgtaataacaaaagaagggaaagacatatgggttcctataagagacttatcaatgatagtattagataatttaaaaacaaacctaacatcaaggatgttatgtgctcttgcaaaaaataatgttggaataataatatgcgaccaagaacatctacctataggattttattcctcctttgacaatcacagcagaatatcaaaaacaataaaatatcaaactgaaaaagatgaaaatttttatgctcttctttgggaaaagatagttaaagaaaaaataaaaaatcaaataagagttttaaagatattagataaaagcgaagatattcaaaataaaatgaatgaattcataaaacaaatgcagcataacgatgaaaacaacagggaagctcacagcgcaaaaatatattttaatgaacttatggaatgttcattttcaagaagaaatgatgatatcttattaaattcggggcttaactatggatataccataataaggtcctttttagcaagagtatgcgttggatatggacttaatactcagcttggaatacatcataaaaacgaatataacagatttaatttcgttgacgacataatagagccaattagaccatttatagattattttgcatataatcttttaaaagaagaaaaatatttcacccctaatcataggagagaactaataaactttttaaatcataaagttttatataacaacaaaaaaatgtatatatgcaacatgcttgaagaatatgtatacaatatagccggatattttgaaggaagaaaggaagaaataatctttccaaatgttgaagattatattggaaaagaaaatgaggtataaagtaatgaaacttttatgtatgtttgacttacccactcaaacatcaagagaaagaaaagattatagattatttagaaaagaattaataaaagaaggttttataatgctgcagtattctgtatacatgagaacatgtcctgacagagattataaaataagaatggaaaagagaatagaaaaaataatacctaaaaaaggcaatatcaggcttgtagcaataaccgaaaaacagtatgaagatatgaaaatattaataggaagcaaaaacgaaacggaaaaggtaataggaagtgagaggatgatagtactttgaaagttcaaatatgtaatagagaaaaagaatatattataaatttaatgcaaataacccagctatgcggagtaaacttttatattaaagattttataataaactccatatataaatacttttcaaatggtaaatatatggaatatgaaaaaaatatggaagaaaatattaaaatagaagatgaaaaattaggaaggaattacttcgatataataagaataaaaggtaaagaagacttaataaatattctaaaaataactaaaaccggactaattaataaatatataaatgataaaatgcaaaatataaattttcaaagacagttaaacattatagataatgcccttgaagaaatatatataaaattaaaccaaaacgaatttaaaaacattataatcgtaatgtaacgtataattataaaaataatgattattatactatagaagatgaaaaatattatgagtcatcatataaatgtagcggtatggtaaaaaataaaggagtattaacattaaaagatagagaatatactcttacaagtgaacctgtaaaatattattattatatttatatagaaaatggagaaaagtatttagaacttacggattattacaatggtcaaatgtttacaggaacgtatttatttagatttgttcaataattttatttttaattataaaagtgttttggaggaaaaatatgaataataaaaccaaagtgtatagaatgcatttaaatccagactttaattgtaaccttggacaagatgatgttataaaattttgtaaagagaaaggcataataggtgtaggttgggaagatataaaggtacataaagattataaagatgaaacaattttgaaagaagtatgtgacaattctaaatacacaaataaaccatttaactccttaaaaatattaagtaaaatcaatgctggagatatgatttggactaaagacaaagaaaataatgtgtattatttatgcatcgttacaaaaacatggtttgaaactagccccgatatttactatgaagatatggatataaaaaattttgtatgctgtaactggaataaaattgataaaagaaatattccagaaaatatattaagaagttttaaagcgcagcagactatattacaagtatagaaaaaagcggtatataaccgcttttatttttttatttctctaattattttgcatggatttccaccggcaataacatcacttgggatatctttattaacaacgcttcctgctccaattatagaattttctccaattgttacaccaggaagaattataacatttcctcctatccatacattatcttctatatttacttcctttgcataacaatatccagcttttcttttttcaggatgctcgttatgacctacggtatatatggaaacatttggagcaattcttacatagtttcctatgtttacttttgcctgtgccagaattgtgcagttatggtttataaaggaatgttttccgatttttatatggttgccataatcacaagtgaaaggaggaagtatatcaacgcttttgtctatttctccaaaaagtttttttaatatttcttttcttttatcaatgtcaactgtgttacatctattgtattcatccataagttttttattttcaagtaacatttgaaaaagagatgaatcttctatatattcttctcctataatcattttttcgtattcacttacgtttccactcatctatttgtcctctgttaaattttttatgactttacatggattccctgctgcaataacatttcttggaatatctttgttgacaacacttcctgctccaattatggaattttctcctatggtaacaccaggcagtactgcactgttccctccaatccaaacgttatcttcaatagttattgtcttagcaaattcataaccttcttttctttttataggctcttttacgtgatttacagtgtatattccaacattaggagcaattcttacattttttcctattatgacttttgcttcatctaaaataacacaattgtgatttataaaagtcccttcatcaatagatatgtgttttccatagtcacaattgaaaggtgaataaataaatacattttctcccttaaaccctaatattttatttaaaagttctattcttttattcatattttttagggaagtaagattatattcttcaactaaagctttgttttttattattttctctattaggtcatttgatggtttgtaatcataaccttgaagcattctttcttcatttgttaaattaatattaatttctttatccattgttatttaaaatttccatagaagttttaaaatgcattttacatacattttttaattcttctttcccgtatttgtttataaattcctttcctttttctataactatcatgttagccccaaggggaaactcaaagttgtagtgcttattcatattttcagtactttttattaaagcatctcttgctagaatactggcagcagcaacagcaatattctgctctgcttttggtttaaaaataatttctttcaaattaagttcttttaggcctgcttttatttgttcttctctcccgaatttatcaactaaaagtttttcaaaaggatgttttttatatacgttttttatgtttgttacatgagcccatgcaagtatagcatttatatttcctatttttgaatataattcgttatatttattttgtttaattcttaaaatggaataattacttgtgacttgttttatttcttttgccagttttgttatttgaatatcacttaaatctttcgagtcttttactccaagttcttttaaaatattgtattgattttcatttaagtaaatacttcctacaataattggtgcatagaaatctcctttcccaacttcgtcgcttcctgttaaaggtggagcaagtattggatatggagtttttatatttgtcacattaaaattaggggaactggtattgttccccttaaattgctcgtatatattgtttagtgtaatatttagttgttcatctttgctttgagatgtatctaaagtaattcccttttttttactggaataaattcttataatattttcatttattctaaattgtattccataagcaatctttttttcttcagatacattatcttcttttaatatttcttttattaaaaggtataaatctttaggtgtcttgttcattatgcctccctatatgggttttacgaaaatcattcttcctgcggctgtttgaagtacacttgttacaacagtatgaatttcttcacctattctgtttcttccttcttctaccactatcattgttccgtcttccaaataagcaatgccttgagaattttcttttccttctttgattactcttacataaagttcttctccaggtaaaacgacagtttttactgcatttgaaagttcattggtgtttaaaacttcaacaccttggaattctgcgattttatttaagttgtaatcatttgttactacttttgcatctatatcaatggcaagttttaataactttgtatcaacttcgcttatatcagggtaatctttatcaagatttacgacttctattggaagttctttttgtatctgattaagaatatcaagacctcttcttcctctgcttctttttacgctatctgctgaatcggcaatttgttgtagttcatacaatacaaagtttggaagtattatcggaccgtctataaagcctgtttttagaatatccaaaattcttccgtcaattattacgcttgtatctaaaattttggctactcctattggaacttttggatgttttttgctttgttttgttctggcattttcattcaagaaaggattaagtcctttaaagaacttctctacatccggagctttgtatgtagctattgaaataaatacatatatacatatcgcatatataattatagttataagacttgcaatccatcccggaagccccatgttttgaaatggaagagataaaagcgcagcaagtataagggccaaaatcaatgaaccgattaacatacctatttgtgtaagtgtagtattgttaagttctatacttacttggtcaaagatacgtttaaatagttttgcgaaaaaaggaataaaaataataaatataaaaccgaataaaatagctgcaaaaacataaatcatacctttcccaaatgcagaggttatgttaattccaagtttttgatacaaatgtccgccgttaataatccaattagcaagttgtgaacctacaattgcaccaagaacaaaaataatggcatataatgcttttttcatttgttgtcacctccttattaaattttaaaatatcacaaggtacaataccttaatataattgtataagaaatatatgtaaaagtaaatatgaattttcttaaagttatcttaaaaatataaaaaaagaatgtgattttgtaagtaaaagaaagtttatatataaaaaaacaaataaaagagtaatatttatgtgttttttatgtaatgtttgttttcacagatttcattccatacgcataaaccacatatatctttccttttcccgggaaatattattttgtttagcactttctcttttaaatctttataatcaaattcatattctatattatttatctcacataaggatagtacttttttgtcgaaaattgaaacttttttgttatctaagcaaatattatttttgttgtttggacattttttgcaaattttatcagtgcagagtgttagtttgattttagtattatgagataaattattaattatattttgcatgtttagagtaaactctttattgtatccttttccttcaaagaaaaggatacaaagtaaatggtggggacgtaaattaatcattttttatcctcggttttataattttacttacaccgtaagcaagagcaattttaataatatcaggaataacaaaggggacaacgcacattgcaagtatagccggtatggttattgctcctgtattagatgtatataagaaataaaaccataatgttccaagagcataacatattattaaagagataaatgaaaataatattaatagtattgtatttttattgtatagtttctcggttagcatcatgaaaattggaataataagaaatcctattatatacccacctgtatttcccatcagtattcctattccggcagtgaatcctgaaaacacaggaatgcctataattccaagcattatgtatactccgactgcgactatgcacatttttgctccaagaataaaaagtataaaatatatggcaaatgtctgcatggtaaaaggtatggacgttggtattgatatccaagctgaaattgcaataaatacagaacacagtgctgccaaaaccaaatcttttgtcttcataatagtatattctccttttgctaatattatttatgccttatttatgaaggcaaatttataataatatacaaaaaaagaaagtgtcaactaatatttatatataggttgacactttcttctatttattgaataaatggaaaatagtttgttttaaactgcttacttttattatttccattccaagagtttctatctgctcattttccgaagtgtatttgggaataatcgccttcgtaaatcccatggatcttgcatcctttattcttttataaatattatttacgttccttatttctccgcaaagcccaacttctccgattattattgtgtcttttgggatttctttttttaatattgatgatattaccgcacaggcaactgccaagtcacttgcggtttcttttacttttatgcctcctacaatatttaagtaaacatctgtttgaaaaagttttacgtttgtcattttttctattacagccaaaataagtacaaacctactgtaatcaaagccggttgaaactcttcttggaacttgaaaagaggactgcattgcaagtgcttgtatttctactaacatgctcctgtttccttccattaatgcgcaaatcacacttccgtaacttctgctttccatctgacttaataataattttgaagggttattcacacactcaagacctttacttgtcatctcaaatacgcctatttcctcgcttgaaccaaatctgtttttgctaagtcttaatattctaaggtcgctgtttgcttcattttcaaaatacattacagtatctaccatatgttctattgtcttaggccctgctattgttccttgttttgtaatatgtcctacaagaaatatgcttgtatttgtagcttttgcaaaattcattaatgtgtttgtacattctctaacttgtgttattgttcccggtgcacttggtatgttttcgctttttactgtctgtatggaatctattataagtaagtctattttgttttcttttgcgctttcaattatctgctctatattcgtattggaaagaacaagaatgttccctcctttaagccccagtctgtcaagtcttaattttaactgggttaagctttcttcgcttgaagcataaagaacttttttgtcttcaagggatacattatatgcactctgcataagaagggtagatttccctattcccggttgccctcctacaagaactatgcttgaaggaactatccctcctccaagtactctatccagttctgatatttttgtagaaaaacgtatttcttcatttgtgtcaatatcatttaagtttgtaattttgggtgtgaatatattttgtttatggtttactatttcaagttctttttttgaaaattcgctgaatgtgttccatgctccgcagtcaggacactttccccagtatttagcactttcatatccacattcgctgcatacaaaaatttttttatctttagccaaatttctatcctctttacttaaatatttgtataaaattataacataatgcctctaagttttcataaatatttggttactaaaatattatatttaaaaaataaaattaatagtaacaaagaagtattatttgtgataaaatgaaaaaaagataatttggcagaaaagagctgtaaaaaagggtaaaaattggaaaatatttaataattttttgtgcttgcccttgacttatatatactcttttgctaaaatattaaattactgaaaatacaaaacaagcctaaaatttgtgttgattttatgcagtttaggacggaggaaataacagcaaattgattaaatcttttatttgaaaataagataattttgctgtgtttttcatgtttaaaaataaggagagtggtacagtgattcatccagagaaaattggtagaagagaaagaatgagtttttctaaaatcaaagatgtaatggaaatgccaaaccttatttctattcaaaccgattcttataaatggtttatagaagaaggtttaagagaagcatttttagatgtctttccaattacagatccaagtgaaaatttaatacttgagtttgtagattatattttagatgacgatccaaaatatgatgttgaagaatgtaaagaaagaaaaacaaattactctgcttctttgaaagttaaagtaagattagttgttaaagaagacggtgaaattaaagacgtaagagaacagcatgtattcatggcagatttccctcttatgacaaaaacaggtacatttattataaatggtgccgaaagagttatcgtaagccaacttatccgttcccctggagcatatttctcaattgaaagagataagtatggtaaagaattatataatggtcaaatcatacctaacagaggtgcttggttagagtatgaaacagatgcaagtgattgcttatatgcaagagtagacagaacaaagaaagttcctatcactgttcttattagagctcttggtcttggaagcaatgaagaaataataaattatttcggtgaagaaaaaagacttatgactacatttgaaaaggatacttctacaaatgtggaagaaggtcttattgaaatatacaaaaaattaagacctggcgaacctgaaagtgtagactcagcaaaaggtctgttcattccgatgttctttgatcaaagaagatacgacttaatgatggttggtagatttaagctaaataaaaaattagctcttgccacaagaattactggacaatatgcattcaaagacatagttaatcctatgacaggtgaaatacttgtaaacaaagatgaaattatagacgaacaaactgcatgggatatccaaaactgcggtattaacacagttgaagtaaaagttagcgatgataaaggatttaaaattatcggtaacggtactgttgacataaataaatatggtttaccttttgatgtaagcgatttgggtattgacgaaagagtaaacttaaaagtcttaaatgaaatacttgaacaagatatttcaaacgaagaaaagaaagaacaaattaaacttagaaagaatgaacttttaccaaaacatatcactgttgaagatatttatgcttcaatcagttataacttaggtcttgaccatggtattggaacattagacgatattgaccacttaggtaacagaagaattcgttcagtaggtgaattattacaaaatcaatttagaattggtttatcaagacttgaaagaacagttaaagaaagaatgatttcttttgaccctgaagaagtaaccccatcaagccttgttaacgtaaaaccagtaaatgctgcgttaaaagaattctttggttcttctcagctttcacaatttatggaccaaacaaaccctcttggagaacttactcataagagaagatattctgcacttggtcctggcggtttatcaagagatagagccggattcgaagttagggacgttcatcattctcactacggaagagtttgtcctattgaaactcctgaaggtccaaacatcggtcttatcggttctcttgcaacatattcaagagttaataaatatggatttatcgaaactccatacagaaaagttataaatggtagagttgttggtgatattgaatatattcctgctgatgaagaaggtaaatacacaatagctcaagctaacgaacctttacttgaagatggtacttttgaacataagaaagtaacaggtagagcaggcgttgaaagggatttcgtaacagtagaaaaagaaaaagttgattatatggatatttctccaaaacaaatcgtttctgttgctacaagtatgattcctttccttgaaaatgacgatgccaacagagccttaatgggtgccaacatgcaacgtcaggcagtacctttattaaaacctcaagcgccaatggttggaacaggtatggaacacagagccgcaaaagacagcggggtatgtgtagtaagtgaagttagcggtgttgtaaaaagagttactgctaccgaaatcatcattactgatgacgaaacaaaacaaaacgtaaaatataaattacttaaatataaaagaactaaccaaaatacatgtataaatcaaatccctattgttaaacttggggacagagttgaaaaaggtgaagttattgccgatggtccatcaactgaaaatggagatttagctcttggtagaaacattcttatcggatttatgacatgggaaggttataactacgaagatgctatcataataaatgaaaaacttgttaaggaagatgctcttacttcaatccatattgaagaatttgactgtgaagcaaaagaaacaaaacttggaagtgaagaaataacaagagatattccaaatgtaggcgaagaagctcttaaaaaccttgatgaaagaggggttataagaatcggtgccgaagttaaatcagatgatattttagttggtaaagttactccaaaaggagaaagcgacccaacagcagaagaaaaacttcttcgtgcaatttttggtgaaaaagccagagaagtaagagatacttcactaaaagttcctcacggggaaaaaggtgtagtaatcgacgttaaagtttatacaaaagaaaacggtgatgaactaaaacctaacgtaaataaacttgtaagagtttacattgcaattaagagaaaaatccaagtaggggataaaatggcgggacgtcatggtaacaaaggggtaatcagtagggttgttcctgaagaagatatgccattcttaccagacggtacaccacttgaaatacttctatctccaatgggggtaccttctcgtatgaacattgggcaggtacttgaagttcatcttggaagagcttgtaaagagcttggatgggatattgcaactcctgtatttgacggtgcaaaagaagaagatattatggaacttcttgaacaagttggatgttctccagacggaaaagttcaactttatgacggaagaacaggggaaccttttgataacaaagtaaccgttggttacatgtatatgttaagattacatcatatcgttgatgaaaagatgcacgccagagcaacaggtccttactcacttgtaacacaacaaccacttggcggtaaagctcaaatgggtggacaaagatttggtgaaatggaagtttgggctcttgaagcttacggtgctgctcatacattacaagaaattttaactgttaagagtgatgacgtttcaggtagggttaaaacatatgaagctattatcaagggtgaaaacatcccaagagcaggtgttcctgaatcattcaaagttcttattaaagagttccaaagcttgtgcttagatgtaaatgttcttggagaaagaaacgaaatcattgacatcagagatgatgcaaacggtgatgttgttgaagatttagatcaagtagaagaaaatgcagataaacctgtaagcgaacttgatgatatggaagttttagatgatgaaattgtatttgatgatgacgaaggtgaagatcttatttcagataattctgaaataagaagtgaagatttggatttccttgaaagtaatattttaagttctgacggtgatgatgccgaagatgaagaatttctataaaatttaaggttactttaggaaaatataaatggaggtacattccttgaaagaatttaatgatgtaaatatagataaaaaagaaaatacaaatatgggcgaaattgattttaaatcaattcaaattggtttagcatcaaaagaaaaaattcttgaatggtcatatggtgaagtaaaaaaacctgaaactatcaactacagaacatcaaaacctgaaaaagacggacttttctgcgaaaagattttcggacctacaaaagattatgaatgttattgtggtaaatataaacaaataagatataaaggcgttatttgtgacagatgtggtgttgaacttacaaaatcaaaagtaagaagagaaagaatggggcatatagcattagctgcccctgtaactcacatttggtatttcaaaggtattccaagtagaattggtttacttcttgaaatgtcaccaaaagaacttgaaagaattatttattttgctgcttatgtagtaacagatccgggtaatactcctttagatgaaaaaacagttttaactgaaactgaatataaagaatacagagaaatatacggaaacgaatttactgcaaaaattggtgcagaagcaattcaagatttactgggacaagtggatcttgaaaaagaaagcaaagaattaaaacaaataatcgcaacagaaacaacaagacaaaaaagaagcaaagcaattaagaaattaaaaatcgttgaagactttaaaaactcagacaacgaccctagagatatggtacttgaagttattcctgttattcctcctgaacttagacctatggttatgcttgacggcggaagatatgctacaagtgacttaaacgacttatacagaagagttataaacagaaataacagacttaaaagacttcttgaacttaatgctcctgacattatcgttcaaaatgaaaagagaatgcttcaagaagctgttgatgcattaattgataacggcagaagaggcagacctgtaacaggacctggaaacagaccacttcgttctctttctgatatgcttaagggtaaacaaggtagatttagacaaaacttacttggtaagagggttgactactctggacgttctgttatcgtagtaggacctgaacttaagatgtatcaatgtggtcttccaaaagaaatggcaattgaattattcaaaccatttataatgagagaacttgtaaagagaaaacattctttaaatattaaatcagctaagagaatggttgaaagacaaagccctgaagtttgggatgttcttgatgatgtaattaaggatcatccggttttactaaaccgtgcccctacacttcatagacttggtattcaagcatttgaaccaattttggttgaaggtagagccataaaacttcatcctcttgtttgtacagctttcaatgctgacttcgatggggaccaaatggctgttcacgttcctttaagtgttgaagctcaagctgaagcaagattcttaatgcttgctgcttacaatatcttaaaacctcaagatggttctcctgttgtttcacctacacaggatatgattcttggttcatattacttaacaattcctcaagataatcaaaaaggtgcaggaaaagcttttgcttcaattgcagaacttgaaatggcttactataataaggaagttgaaattcacgctcctgttaaagtaagaatgaaaaaagtaattgatggaaaagaacatgttaaagtagttgaatcaactgttggtagattcttgtttaaccaaattattcctcaagatttaggatttgttacaagacaaactccggcagatatgtttaaacttgaaattgataaagtagtagataaaaaagttttatctgaaatagtatataaatgtttcacaagacatggtgctgcaaaaacatcaatggttcttgatgacattaagaaaataggtttcacttattctacaaaagctgccgtaacagtaagtatttctgatatggaagttcctgaagttaaacatgaacttcttgaacaagctgacgaaaaagtagaaaaagttcttaaacagtataagagaggtatgattaccgaagccgaaagaaaaagagaagttattgatatttggaatgaaactacaaaccttgtaacaaatgcgttacttgataaccttgacccattcaacccaatcaacatgatggctgactcaggtgccagaggtagtagaaaccaaatcagacagcttgccggaatgagaggtcttatggcatctcctaacggggatatcatcgaacttcctatacgttcaaacttccgtgaaggtcttgacgtacttgaattctttatctcttctcatggtgcgagaaaaggtcttgcggatacggctcttagaacagccgactctggttatttgacaagaagacttgttgatgtaagtcaagatcaaataattaaagaagaagactgtggaacaaaacatggttatgaagttactgctattaaagtaggtaatgatataatcgaagaattagaagaaagaataacaggaagatatgctttcgacgatgttgtaaatccaaatacgggagaagttattgttgctaaaaatgaacttattacagcaacaaaagcaaaagaaatcgttgattgtggtattgaaaaagtaaatatcagagcggtatttaactgtagaagtaaaataggtgtttgtgctaaatgttacggggttgatttaacaagcatgaaacctgtaagtataggtgaagctgttggtacaatcgcagcgcaatctatcggggagcctggtacacagcttacaatgcgtacattccatacaggtggggttgcttcagctgaagatattactcaaggtcttccaagaatcgaagaattatttgaagcaagaagaccaaaaggtcaagctatcatttctgatattgacggtgttatcgaaattaccgaagaagacggacacagcaaagttatcgttatgaataacgataacggagaagtattcgaatatgatattccatatggtgcaagagttaaagtaagacaaggggataaaatagaagccggtgatgaaattacagaaggtagtatttaccctgaagacttattaagaatcaaaggaattgacggagtacaaaaatatattttaacagaagtacaaaaagtatatagatatcaaggggttcatatttcagataagcacgttgaaatcataataagacaaatgcttagaaaatatgaagttgaagatgcaggagaaacagaattacttcctggtacaagcgttgacttatttgaatttgactctgcaaatgaaaaagcaagagaagaaggaaaacgagaagcaacaggaagaagaaaacttcttggtattacaaaagcatcactttctacttcatcattcttatctgcagcgtcattccaagaaacaacaaaagttcttacagatgcagctattcaaggaaaagtggatccgttacttggacttaaagaaaatattatccttggtaaattaattcctgcaggtacaggtattaaaaaatatgaacttgagcttgttaaaaataaagatgatgatgatgatttgttaaaagatatattaaatgaattaaatgaagattctgataatgacttaactacaggcggtgaagatttaacaattcacagcattgatgaagatgatgattttgatgctaatgttacttcagattttgatttagataacaatgatacaatataaaaaataattaaaatctacggcttttaataagccgtagattttagtacatatataaaagcagttaagaagaggagtaaaagtaatgtctaaaataggattgttaggatgcggaaccgttggaaccggggtatatgaaataatcaatgaaaaaaaagggaacttcttcgaacaagacgactatacaattaaaaagattttagtcagagatacatctaaagaaagagaaggtattccaagcgagcttttgacaagtaatccggatgatattttagaagatgatgaaatatctttaatagttgcggttatgggtagttatgaacaagaatatcctgcaattaaaaaagctttaatgaagaaaaaagatgttgttaccgcaaataaagaaattatatcaaaacacatggaagaacttctaaatctttcaaaagaaaacggagttacattgctttttgaagcaagtgtaggcggaggaatccctattattgaatctataatagatacaataaaaataaataaaataaacaaagttcaaggtatattaaacggaacaacaaattttattttatctaaaatgacaaaagatgaaatggactttgatgaagtattaaaaatagctcaagatatggggtttgccgaagcagatccgacagctgatgttgacggttttgatatttcgagaaaacttactattctttcatctttatgttacggtgcatatatagacaacgatgatgtatgcacaagaagtgtaagaaacataagtttatctgatataaaaactgccgatgaactgggatatgtttttaaatatatggctgaaagcgaattatatgatgataatacatttggagcaacagtaactcctgtattaatcggtaagaattctgttacaagtaatgtaaatgatgaatataacgttataaatataaacggtaatataatcggacagctttctttccttggaaggggtgccggtaaagaagcaactgctaatgccgttgttgctgatgtaataaaggttctaacaaaatctgtacatgattatacacatttaaaatttgaaaataaatataacagttgcggtatagaaagatataaaaataaattctatttaagagtttccgtggaaaatgaaacagaattttcaagagctattgatatagtgtatagaaatataaacaacattaatctatcttatgaagacggaaaaatattcttggttacggaagaaataacaggagaatttatgagtacgttgtgtgatagattatcccatgttactgaagatgtattttatgctagaataatcgatgatatattataggaggagaattaaatatgagaaaagatgatagcattataaaagcaattacagttgatgaagacatcgcaaaaatatctgtaatggaagttcctgataaaccgggtattgcatttaatttatttagtaatattgccaatgaaggaattaaaatcgaaagtattactcaaaatgtaaacagaagccaagtaaatgatattacttttacggttccaacagatgaatttgaaaaagcctttaaaataacaagtgatttcgcaattgaagttggtgctacaaaagtattatatgataaaggagttgcaaaattatcagttataggttccggtatggttgcaagtactcaagtagccagcagagtttttaaagcgttatatgaaaaaggcgtaaatattcaaatgatttctacaagcgaagtaaaaatttcttgtgtaatagaaaaagataaagcaaaagaagctttaaaacaaatttataaagaatttgaagttgaataaaaaaagaccttaaaggtctttttttattgaagtatatatgcttccattgttcttcttccaaatgccaaagcggctgagtgagagtcgaaataaatatcaattctacctgaacttatagctccgcctctgtcttctactacgtatactcctccgttagagttacctgaaagagcagggaagtatacttttgttccaaatggtaatccgctccatgcggcgattgttcttcctgctgttgcacgtgttccacttgctgtaattcccgtagatacatcgcagcactttgcacatgcacagtaagctgtaacttcaaccgtaattttttgattatattttaccggtgcgcttccgccattttcagctataagtatggtatcatcggaatcttttgcaacttctacgattttgttttgaacttttgtttcaactgtttttgttaaattttttgtctttacaacttcacctttagaatttgttgtaacaacacttatgtaattaattttaccatttttacctttttgaacaactttttcatcttcgccgtccaaagtgtctacttctttatatattgttttatatttaactttttctgttttgtttacaagtttttggttttcatctaaaactgcataaacggaagtgttatcatgcacaatacttgaaacttttttaccatctgatacttcaaatccggcttgttctataatggcattttcatttataagccctgtatctactttaacaatttcgcttccgtctgttacaagaacttttgatgctgttgtgatttttattacatcattgtcctttaaatttgcatcaagagatttagaaattgtatcggtgcttgaaggggtaatttttgcaatgcttaaagcatctgccgttgtaagagaaccgatttgtttaaccgtaaccggatcgtcatcatcaactattatactaacagtcattgtcgacatactaataagaattgcgcttacacctatcattgcggtaataaagaaacatatgcataaaggaataagttttttgtttaagtaggcttttatttttcttttgtgtttactttcattaacaaaatctttttgctcatcaagcttgtctaaatgatctaaagcctcgatgacatccatattctcttcttcaattaatttctttgcctttaaagtatcgtcgtctatttcctcaagggagtcttttattaaattagtttcttcagaatttattgtagtattattttcattggctttattattactttcctgtactacgttaatttcttctttatgatttttgctgttttcttgtattaaattaagttcttctttatcttcatttaatacttcttcagttttatcttcctttgtaactttactaacaatattatcatttgatgtaattgtactttttaaatcttgaagattaaattcttccgtttcaaagttttcttcttttgtttgaagattgtcttctaaaatagaggtttcttcattaaaaatatcttcttttgtattttccaagtttgaagatgtgtttgaaacttcattaataaattcttcttcgttaaaatcttctaaagctaaattaacatctttatcaaggtcaatattttctttgtagttattttcagaatttaaatcatctaaagttaatgtcaatttgtcatctaaggaagattcatttttaattttattttttttcaatttaactttgtttttcggttgtttgattttatcaatcttatccaaaaaattatctttaaatttactcatatttaatcaatccttctaaagattttttgtatatcaaatatacattaattgtaggcttttgtcaaattttaaagcattttaggggattgtaaattctaccaccactatattatgtggtatatatatttgtggttttataaataaatatttttttatttataaaaatttaattatatttgaatgaataaatattgtagctaaacaaaaaataaaaaataaaaccatatttatcaatataagtaaaattttactgattatttttgattaaaaatgattaaaaatgattgacaataaacaaaagtggtgatattatacgcttataaaaaggaagtgataatatgctgacagaaaaaagatatgaaaaaattttagaaattttagaagaaaaaggcattgttacagtaaaagaaattactgaaagattaaattcttctgatgcaacaacaagaagagattttaatgctttagataaaatggggaaacttaaaaaagttcatggtggtgcaacaaaaataacaagtagcagatttgttattgaagaagagcctataagtcaaaaggaaaacataaacaaggaagaaaaagacactgttggtaaatttgccgcatctttaattgaagaaaatgattttgtatatattgatgcaggaacttcaacaggagaaatgattaagcacataagtgcaaaaaacgttacgtttgttacaaacggtctttatcatgctttaaatttatcaaagcttggttacaaagtttttatattagcaggtgaaacaagagaaatgacaggatctgtagttgggagtgaatctgtaaaaagcatacaaaaatacaactttacaaaaggcttttttggaacaaacggtattgatttaaatgccggatatacaacatataaagaaagtgaagggcttataaaagaagctgctataaaaaaatgtaaagatgcatttattttaacagacagctcaaaatttaataaaattgccccaattactttttcaagtttagataaagcaacaattattacttctaattccgttgatgaattatttatggaaaaaacaaaaataatggaggcaaaataatgatatatacagttacatttaatcctgcgcttgattatgtaatgattatagacgaattcaaaagcggtaatgtaaacagatgtgaaaatgaatttttaaatccagggggaaaaggaataaatgtttctaccatgttaagcgaacttggtgaagaaaatgttgcccttggttttattgcaggatttacaggcagggaacttgtaaataaattaaatgaaagaaatattaaaacaaacttcatagagttaaaagaaggtttaacaagaataaacgtaaaaataaaaggaaatattgaaagcgaaataaacgcaaaaggtcctaatattgacaaagaagatttgcaaaaacttttaaatcaaatagatacgttaaaagataacgatatcttggttttggcaggaagtattccttcatctatagatgatgatatatatgaacaaattatgaaaagactaagtgaaaagaatgttcatgtagttgtagatgcaacaaaggatttacttaaaaatgtactaaaatataaaccgtttctaattaaacctaatcatcatgaattggcagaattctttgatgttaagataaattctgatgaagaaattgtggaatatgcaaagaaacttcaagaaatgggtgctgaaaacgtgcttgtatcaatggctgcagacggcgcaatccttgttaccaaggaaaatgaagttatcaaaacaaatactccaaaaggaaaggtagtaaattccgtaggggctggagattccatggttgcaggatttatttatgggtatttaaaaaataaagattataaggaagctttaagattcggaagtgcagcaggaagtgcaagtgcattttcagaatcaatagctacaaaagaaaaagtagaagaattattaaaggagctttagagggaaaatgaagattattgatttattaaaaaaagaaggtattgcccttaaccctgaagttaaagataaacaagaagcaatagattttcttgttgatttaatggataaaacaggcaatatatcagacaaagaagaatacaaaaaaggtgttcttgcaagagaagcgcaaggaacaacaggaatcggggaaggggtagcaattcctcactcaaaaaataaagccgtaaaacaagcaggcttaagtgcaatggtaataaaagacggcttaaactttgagtctttagacggacaagatgcttatttattctttatgattgcagcacctgatacagatgctaacgttcatttggaagtattaagcagactttctacattattaatggatgaaaatttcagacaaagtttaattaatgcaaaagataaagatgaattcttagcaatgattgataaagctgaaaaagaaaaattcaaagaagaagctgaagaagaagctcaaagtaacgatggttactatgatgtacttgccgtaacagcttgtccaacaggtattgctcatacttacatggctgctgaagcacttgaaaaacaagccgaaaaaatgggcattaaagtaaaagttgaaactaacggctcaggcggagttaaacataaacttacaagtgaagaaatagaacatgcaaaatgtattatcgttgctgccgacaaacaagttgaaatggcaagatttaacggtaaaaaagttattcaaacaaaagttgcaaacggaattaataaagcagaagaacttttaacaaatgctatgaacggaaatgctcctgtttatgaacatagcggagaagtaaaagttgaaagtgaagaaaaagaaagtatcggtagacaaatttataaacaccttatgaatggtgtatctcatatgcttcctttcgttattggtggtggtattctaattgctcttgcattcttatttgatgatgcaagtcttggtgctgatacattcggaacaaacactccatttgcagcattcttaaaaacaataggtgatacagcatttggatttatgcttcctatattagcaggtttcatcgctatgagtattgcagatagacctggacttgttacaggtttcgttggtggtgctcttgcaaatgctggtggttcaggcttccttggagctttacttgccggatttattgcaggatatttgatgatattccttaaaaaagtattctcaaaacttcctcatagtttagaaggaatgaaacctgtacttatttatccactacttggtgtattattaatcggtgctatcattacttttgtagtaaatcctcctgtatctttactaaatacagcaatgacaaacggattaaatgcaatgggtgaatcttcaaaagtaattttaggtgtaattcttggtgcaatgatgtcaatcgatatgggtggtcctttcaataaggctgcatatgtattcggtacagcatctcttacaacaggaagttatgatattatggcggcagttatgattggtggtatggtacctcctcttgcaatagctctttgtgcaactttctttaaaaatagattccctaaagaacagagaagttctgctcttacaaactatgtaatgggactttcatttattactgaaggtgctataccatttgcagctgcggatccacttagagtaattccatcatgtgctattggtgctggtgttgcaggcggtttatcaatgttatttaactgtacacttcgtgctcctcacggtggattctgggtaattgccataattggaaatcctttatattatatacttgcgttagcaatagggtcttttgtgggaatggctttacttgctatactaaaaaaacctgttcatgataaataaaacctaaatataaaaaagctcggtatatgccgagcttttttattataataaagttaattataaaatcggtaaaattcttttatataaagcaatgcgtttatcatcaatatccatatcttcatgaaaatgaccaaaataatgttttttatattcacaagttttttcaattttttcaagatatttatttaatttgtattcgtcttttaaacctttcttaaagatgtttttatttattgagtaaggtgcggtgtggcttattatgtagtctattttataattatgtaactttaaattctttaaaccttcttcatattcttttttatttggcatttcttcagcccaccaagttctgccattttctcgcattgatttatctatggagtttccgcctccaaaagtaaagaattttttatcttctattgtataaacttgtcctctcattaaatggattatacttggttttataaattgaacgttgcctcccatccattttgtaactttatatcttttcagtaaatcaaaattttcatgatttccgtctacccatagtgtagtaaaatttttattttcaagtttgttaagataaaaattatctcctcttccatttccccaaattcccccaaagtctccgcatattattaaataatcattttttgtcatatctctttgttctgggaaatacttttcttccagtttttttatatcaaggggaatatgggtgtctcctgtaacgtatatcatatttatacctcatttaatcgtaaatatataaatcctttcaattatttatggttatcttttgttataaatgctataataacaaattggatataaatgtatttaatggaaaggacatatttaatgaatatattatcaaaattatctaataaaaacaaaggagttatgtttattattttatcttccttttgctttgctgcaatgaacgtttttgtaagaatggcaggagatctgcctttcattcaaaagagtttttttagaaattttatagcattttttatagctttatttttacttcgcaaaagcgggataaaatttgaaatgccaaaagggtctaggttagatttagttctaagagctacatttggaaccataggaattttttgcaattactatgcaatagaccatatgcttgtaagtgatgcatcaatgcttaataaactttcacctttctttgtaataatattttcttattttattttaaacgaaagaattaagccatttcaagcattatgtgtattaattgcatttgtaggagctctttttgtaattaaacctggatttacgggaatgcctgttttccctgctttaataggtacaatgggagggatgtgtgcaggtattgcttatacatatgtaagaaagcttggaactcaaggtgttaaaggaccttttatagttttcttcttttctgctttttcatgtcttgtatctcttccttatttaatatttgaatttactccaatgagtgtatatcaaatatttattttactattgacagggcttgcagcctcaggagggcagttttttataacggcagcatatacttatgcacctgcgggagaaatctcaatatatgactactcacaaattatttttgctacgttcttgtcctttgtttttttaggacaaattccggatatgttaagcgtagttggatatgtaataatatgtattgcatcaataataatgtttttatataacaataataaaataatgttaaaggagaaataaaatggatttaccaaaagacccaataatacttttaagttttataaatacaaaattaagagatttttatccaaatttgcatgagctttgtatggatttatcagtagatgaagaagaaataataaataaactttcaagtgtagggtatgaatataataaagaaagaaattgttttgaataattaaaagccaaactatttagtttggcttttaattatataatttaagtaataataaaatggaacttacaaaaaccattaaaatggtagcaaggactattattattttatctgctgtttctttttttaatatttttgtaaatatattataaaatactacaccaagtaatcctcctagtatatttagtataatatcgttttagaacctgacaattttgatattgaaattttttattatgctgattatgaaaaaacacaataatatctaataaatagatattattgcgtttttttatttgtcaatatttgtttgtgtctgatataaatcttcataagattcttcttcgtcattatttttaggtatattttgtattaatcctgtacattcagttgatgatatggtttttgaattgtttaaaaaatcagtatcgggtggatttaaatcttttttgtttattttcataataacctccttaatatttattttcccaaatattaaataaaatattaaaaaaagagccttaaggctctttttattcttcaaattgagaattataaaggtttgagtaaaatccgttttctttcattaattcatcatgtgtaccttgttcaataatatttccttcattcattacaagtattaaatctgcgtcttttattgtggataatctatgtgcaattataaaacttgttcttccttttactaaggtatccatggcttttacaattaatttttctgttcttgtgtcgacggagcttgttgcttcatctaaaattaaaattttagggtctgccagcaatgctcttgctattgttagaagttgtttttgtccgcttgaaatattgcttgcttcttcgtttaatatcatctgatatccatcaacatttgtttttataaaatgatcaacgtgagtagcaattgcagcttgttctacgtcttcatcagttgcgtttaaattaccatatctaatattattcattacggtatcattgtataaccatgtatcttgtaaaaccataccaaacatttttctcaaatctctacgtttgtaatcatttatatttacaccgtcaacttttattgaaccgctgtttatatcataaaatctcattaatagttttactattgtagttttgccagctcctgtaggtcctactattgcaattttttgacctggttttactttagaagaaaaatctttaatgataggtttattctcatcatatccaaaatatacatgttcaaattcaacgctgcctttaacattatttagattaacttctttaggtgcggttgtagtttctttttcgtcttcttcatctaagaattcaaaaactctttcagcagcagctgctgtttgctgaagtatgttagaaacatttgcaagttgtgttattggctgagtaaagtttcttacatattgtataaatgcttgtatatcaccaactgttataaatccttttgttgctctatatcctccaaggatacaaattgctacatatccaaggttactgataaagctcatgataggctgcatcatccctgataaaaattgtgatttccaagctgaatggtatagagtatcgttatattcattgaaatcattgattgattgtttttctctattaaatgctttaacaatagagtgtcctgaatacatttcttcaatatgaccattaacgtgtccaaggtattcttgttgacttctaaaatacttttgtgagaagtgtattacagtcataataaatattgaagaaataggaatgataagcaaagcaataatagtcattgtgatatctatgcttgccatcattattaaaacacctattaccgttgtaatacttgttattatttgtgtaagtccttggtttaagttttggtttattgtatctacatcatttgttattcttgataaaacttcacctgtttgttgtttgtcatagtattttaaaggcagtgtatttattttatgagagatatcttttcttaagttgtaagttaattcagttgtaacaccggtcatgatatgtgattgtaaataagaaaatatggcagatactacatataaacatactaatataataagtattttaccaacatatacaaagtcgattccggctgttgttcctgcaatttttcccattacgccttcaaatactttcgttgtcgctttaccaagtattttaggtcctactatattaaataccgttgagattactgcaaatataaaaacaataaatatttgtattttttttgttccgagataatgaagaagttttttcattgttcctttaaaatctcttgctttttctccgcctctcattgcaggcattcctctcatcggtcctcttttatgattactcattgtttcttacctcctcttctgataattgagataaggctatttctttatatacttcacaattttgcattaattctttatgtgtgccctttcctacgatttctccatcgtcaagtactattatctgttttgcatgcataattgtgctgattctttgagcaactataattattgtagcatctgataattctttatttattgcactacgaagatttttatctgttttaaaatcaagggcagaaaaactatcatcaaaaatatatatttctgcattttttacgattgctcttgctattgataatctttgtctttgacctccggaaacgttagttcctccagacgcaatttcagtttcaaaaccatccggttttccttttataaattcacttgcttgtgcaatatcacaagctttccataattcctcatctgttgcattttcttttccatattcaagattagatcgtattgttcctttgaataagactcctttttgaggaatgtatcctattttatctcttaaatgtgcttgattaatatcttttatgtttactccatcaattaatatttcacctttacttgcttcaaaaagtctcggtattaattgtacaagtgttgatttaccgcttcccgtagaacctacaattgcggtagtttcacctttattagcggtaaagtctatattgtgaagcacatattcactagcacccggataagcgaaagaaacgtttttaaattcaacaactccttttttgttatcatcaaaaggtttttcttccttagggtcttttagttctaaaggtgtttgtaagacttcatttattctattagcagaaacacttgctcttggaaccataataaacatcattgaaatcattaagaatgccataattatttgcatagcatattggataaatgccatcatatctccgacttgaagggtgcttgcttctatttggtttgcgccaacccaaacaataagaagctgtacaaggttcataactaacatcataaaaggcattaagaacatcatgaacctattaacaaacaagttgttttttgttagtgttttatttgtgtcatcaaatcttttttcttcaaaatcctctgttccaaatgctcttataaccataagtcctgataaattttctcttgcaacaaggtttaatttatctgttaatttttgtatttttttaaatcttggaagtacgatgctaaaggatatcatcataaatcctaatattactattactgcaagaagaattatccaactcattgatgtgctggagctaagggctttcattattgcaataactcccattataggtgcataacataatattctaagtcccattacaataagcatttgaatttgtgtgatatcatttgttgttcttgttataagagaagatactgcaaatttattaaattcaacattagaaaaactttcaacttttgcaaatacatcttttcttagagctcttgcaactcctgctgcggttcttgatgcaagaaaacctacagcaatcgcacaaacggcagaaataaatgcaattaaaagcatttttattccaatatttaaaatgtaggatgattggacattttcaagatttagtcctacttgttgatattcaccttttatataagtacaagcaatttgagatatacttgtttcgggaatgttgtcaagttgagagtttattttatttaaaaattcatatctgttttcttttggcatattttttattaaagaaaacatatctgtattacttgacatcattaaactcatatcagctgttttattgttattttctgttgtatcaatatcaaataaattttgtttttgcattttttcaggattatcaataaaacttacgataatttcgcttttcccaactgctaagtctaatgaattaataatatctttgtttacattgttcttaagaacatatacgttttctttttcaagaatagaatattcttttttgtatttatcataatcactgttttcttttgtgatttttgaataaatgctgtcaagctgtttttgttcattttcttctaagaaaaatttaactttttcatattcactttctcttattacttctggaagattgttttcaatgccgccattttgtattccgtagtctactatcttagacatataatcaggtagagatagttcgcaatttgcctgtattaatagaaatacaattgaaaaaataatagagaagatgaaaggttttaaatattttcttaatttaatcattataggtcatttcctttctggttatttttggctatttctactatttctttaaaaatatccgtaagttgatttactttttctttccccaatttttcgataatattcataagttcactgaatctggattcaaaggtttcattaaaaatttttattccttcttgggttatttctactttgaattttcttctgtcttttttatccattatccttactacataaccttttttttcaaggctgtttaacgtttgtgtgaccgccggtcttgataatttagtcttttcgcttattgttgaaggtaaaacactgtcgatatttttttctttcttttgtttaattaaaaaagcgagaaggaaaaattcagatttcgggagtttaatgtcacattccgcttttgaacctaagattttaccgatagagtgcagataataaataaattctttgatttcttttttttcaattttatcatgcatttctttatcctctctaaaacaaaaaaagcaacaaatagttaagttgcttaattattttgttgcttaattatattactgaaattttgatatgtcaatataaaataatttttataatgaaattttaataatttgcatgtctaagtaaagttcttatttcgcctataaggtataaggatcctacaaatgcatatatattttcactatttttttctattaattcaattgattttgccgtatcagtgatatatgatacatgggcatttttatctatttgtttaattttttcatacatatctttgcttgaaaaagcacggttattatttggcgtcagagtataaattttttctgcttttggcaaaagtttttttaatgaactatctatatctttatctgctaacattccaaaaaacagtattattttcttatttttaaaataaatatttaagttatttacaaaactttcaattccttctttattatgccctccatctaatattattattggatttttggagaaaatttcaaatcttccattaaaatgtatattttctaatgcagttagtatatcttctttttttattttatatccaagtgaataaagtacttccaaagtttgtaaaactgttaatgcattatacacttgatttttaccaagtaaagaaagtttgaattcattcatattaaaagggtttgtttttttatatttaattttgcttccgtcaaaactgctttctattaattcaatatcttcttttttgggtaaataaaaagaagtatttttttctttagatatttttataagctcatctacagcttctctatcggaaggatatattacgacatttgaattttcttttatgattccgcctttttcatatgctatcttttttaaggtatttccaagttgctcaacatggtcaaaacttattgatgctataacacttattagaggattgtttataacgtttgtagcatctaatctacctccaagccctacttcaagtataactatatcaacatctttttctttgaagtaaagtagtgcggctgcagttattatttcaaattctgtaggatgagggaaattattttttatcattttatctattttatctttaactactgatacgtaatatgctatatccacatttgaaatgtctataccgtttatttttattctttcattaaacttttccaaaaaaggtgaagtgtatagacctgttttgtatccagactttgataaaactgcatttaacattgttgaaatagagccttttccgtttgttcctgctatgtgaattacctttaaatcatcttgaggggttcctataagtctaagtaattcattgatattatcaagtccaagtacagatccgaatttatttgtagaatgtataaaatttattgcttgttcgtagttcaatttgtatctccttaatataaaaacttgattaaaattatatcatatttttgaaaaaaatcgggagtaatatataatattttgaaatattcagaaaattgtatcattttacttgacaaaagaaaatagtaagggtaagataataacaattattaatatatttttatattaattaaaaaaattagttaggggtatagacaatgaaaaagacaatgaaaaaagctgctgctttacttttgtctgcaacaatgcttgtaggatttagtgcatgtggaggaagcagcgcagaaaattcagacacaattaaaataggggttaactatgaattgtcaggtgacgttgcaacatacggacaatcttgtacaaaaggcattgaaatggccgttaatgaagtaaacgaagctggcggaattaatggtaaaaaagttgaaattgttaaaattgataacaaatcagataacaatgaagctatgagtgctgcaacaaaacttgcaagtaaagaaggcgtaagtgttatgattggacctgctacttcaggtgctttcaaagcaacaatcgcagctgcaaatcaatataaagttcctgcaattacatgttcaggtacatcagatgatattacagtagattcaaacggaaatgtacaagagtacatatttagattatgttatacagactcattacaaggtagtaaaatggctgaatttgcaactaaaaaattaaatgcaaaatcagcaatcgttttagctgatacatcaaatgattattcaaacggacttgcaaaagcatttgaatcagaatttaaagcaaacggaggaacaatcgtatcaacagaaacatttacagctcaagataaagatttctctcctgtacttacaaaaatcaaagataaaaaagctgatgtaatttacttaccaggttattacacagaatgttctttaattatcaaacaagcaagagaattaggtattgatttaccaatcttaggtgctgatggatatgattctccaacaatgcttgaaacagcaggtgccgaagcacttgaaaatgtatattatacaaatcattatgcagtagatgatgaatcagaagttgttcaaaatttcgtaaaagcttataaagctgcaaataacgatgaaaatcctggtgcttttgaaacattaggttatgatgcaggtaaacttgcttgcgatgcaatcgctagagcgggaagtgctgaccctcaaaaagtttctgaagctttagctgcaacaaaagatttccaagctgtaacaggtactttaagtattgatgaaaaacataatcctgtaaaagaaacagtagtacttgaatttaaagatggaaatgctgtattcaatacaaaactttaattgaataaaatatttgaaatttattaacaaataaaataaattttggtaaagtggtgagaaaaactcaccactttactgcagttttaaggatatgattaaaacaatatatgaatataatatggttttaacaatatttttaaaataataaagatactgggggtacataatttggaacaatttattcagcaaattatcaatgggatttccattggtagtatttatgccttgattgcgcttggatatactatggtttacggaattataaaccttattaactttgcgcatggagatattttaatgataggaggatatgtaggatttttctgttcatatacgctaggaataggctttatacctgcaactattattgcagttataatttgttctatacttggagttgtaattgaaagagttgcatatagaccactaagacatgcaccaagaattacacttcttattacagctattggtgtaagtttcttgcttgaatatgcaatgatgtattttgtaggtccggatgttagaacatatccttcaggattttttggacttggttacattaatttaggcgggatttcaattccaagtgacaaattaatggttacattgattacactagtattaatggttttattacagttattaattagtaagacaaaaatgggtaaatcaatgagagctgtttcatctgatccagatgctgctcaattgatgggtgtaagtgtagataaagcaatttcattcacattccttattggttctgctttagcagctgttgccggtgtaatgtatggtgctatgtttactgtaaatccattatcaggtatgacacctggtttaaaagcttttatcgctgccgtatttggtggtataggaagtataccgggagctatcgttggtggtgtatcacttggactaattgaaactttggttagtggttatctttcaagtgcatataaagatgcggttgccttcgcaatccttataattattcttattgttaaaccgtcaggtttacttggaaagaatagaaaggaaaaagtataggaggtaacgtttaatatgaaaaagattttagatatgtttaaaaagcaagatccaagtaagatacttggattaaaaggaaatattcctactgtaatagcttttgttgctgcatatataataataaagttattaatttttgttggaattatttctccattctatgaaactattgtattaaaactttgtatagatattattttagctcttggtctaaacttaattacaggtattacaggacagttctcattagggcatgcgggatttatggcaataggtgcatatacaagtgctcttatgactcttagaatgtcagatagcattgttatggttatccttgcgttaattttaggcggaattttatcaggatttttaggatttttaattggtattccaactcttcgtttaagaggtgactaccttgcaattgctacattaggtcttggtgaaattatcagaattgttattcaaaacgtagaccaaactatccttggtggagctgccggattgtcttcaatccctttatattcttcacttgaagtatgttttatatgtatgtttatttgttattttgtaataacaaatgttttaaaatcatcatatggtagagcatgcgtatctgtaagagaagatgaaatagcggctgaatcaatgggtgtaaatgtaactaaagcaaaaattcttgcttttattataggaacattctttgcaggtgttgcgggagcattatattcgggttatgtaggcgttattcaaccaaagaactttggtttcatgaagtcaattgatattttaatgattgttgtacttggcggactaggaaatattaatggaacaattattgcagcatttgttttaaatattatttcttttgctcttcaagacttctcagaaatcagaatgattttatatgcgattatgttaattgccataatgcttattaaatcaggtgaaactcctttctttgttaaattaagagaaatgttttctgttgaaaagtttaaaaataaaataagaaagaataaagatgtagtgggggaatagtttatggcaatattaaaaattgaagacttaagtaaaagttttggcggcttaaaagctgtttctcatgtaaatataaatgttgaaaaaggtgaattaataggtctaataggacctaatggggcaggaaaaactacaatatttaacttgcttacaggtgtgtatactccaacatcaggtaaaattgaattaaaaaatgataaaactggagatacaattttaattaacggtttaaagccttatataacaagtagctttggtataagcagaacttttcaaaatatcagattatttaatgaacttagcgtacttgataatttaagaattgcaatgcataaaagagtaaaatataatattttctctgctatttttagaactaaagcatacagagaatgtgaaactattttttatgaaaatgcaatgaatattcttgaatttgttggtcttgcagataaaagagatgaacttgctcaaaatcttccttatggagaacaaagaaaacttgaaattgcaagagctgttgctacaggggcaagtgtaatattccttgatgaacctgcagcgggaatgaatccaagtgaaacagatgaacttagaattttaatagaaaatttgagaaagaaatatgaattaacagttatcttaattgaacatgatatgaaattcgttatggaaatatgcgaaagaatatatgttttagactttggtacgattattgctgaagggaaaccggaagaaataaaaaataacgaaaaagtaattaaagcatatttaggggaggaagtatagaatgttttttaaaattgaaaatttaaatgtacattatggtgctattcatgccctaaaagatgtttctttggaagttaacgaaggagaaattgtaactttaatcggttcaaatggtgccggaaagacatctactttgagaacaatatcaggtcttgttccaaaaacaagcggaaatattgaatttatgggagaaagtcttgataatgtaaaagctacggatatcgtaaaaagaggtatttctcatgttcctgagggaagaagaatctttgctgatatgactgtttatgaaaatcttgaaatgggtgcttatttaagaagagacaaagatagtataaaaaaagatattctagaaatatacaataagttcccaagactaaaggaaagaaaaaatcagcttgccggaacacttagcggcggagaacaacaaatgcttgctatttcaagagcattaatgtccagacctaagtttttacttttagatgaaccttcaatggggcttgcacctgttatcgttcaagatatttttaaattaattaaacaaataaataaagaaggtaccacaatattcttggtagaacaaaatgcaaatatggcactttcaatatcaaatagagcatatatacttgaaacaggtgaagttgttatgagcggagacgcaaaagaattacttcaatcagatgatgtaagaaaagcatatttaggtggctaaaatataaaagtgaaattaacttcccattaagttttttaatgggaagtttttgcaaatataagatgtatttattttgttaaattatataaaaattctgaaaattcttaataatttagtttaaatacttgtacttttttgataaaatttatataattaaaaaatcaataaaaaaaataataataaataataataaataattagatagaagaggatgatgcggtatgaaattaacaggttctgaaattgtagcagaagtattattagagcatggggtagatacggtgtttggttacccgggaggtgcagctttaaatatttacgatgtattatataaatatagtgataaaattaagcacgtccttacggcacatgaacaaggtgcagcacatgcagcagatggatattacagagcaacaggtaaaacaggcgttgttattgcaacaagcggtcctggggcaacaaatcttgtaacaggtattgctacagcatttatggatagtattcctatggttgccattacagctaatgttccggataatttaattggcagagattctttccaagaaatttgcataacaggagttactttacctataacaaaacataacttttttgttaatagagtagaagatttagaagatgctttaagagaagcttttagaattgccaatagcggaagaaagggacctgtactagttgatattacaaaggatgtaacagcaaatttggttgagtataaaaaagaaggaccacttcctttatatgaaaatcctattgcaacagataaagaagttgaagaagttgcaaaaatgattaataattcagaaaaaccggttatatattttggtggaggtatagttgcatctgattcaatagcagaattaaacgagttacttgaaaaaggtgacatacctgcaactaatactttaatggcaacaggtgttcttggatacaacaataaaagaagacttggaatgattggtatgcacggaactgttgctgcaaataaagctatatataatgcggatttggttttagctcttggaactaggtttagtgacagagttgcacttaatccaaacaaatttgcaagcaatgcaaaaaaaatacaagttgacattgataaaagcgaaattaacaaaaatgtttttgtacataagagcataataagtgatgtaaaaaatttcttacaaagattaattcctttaattgaaaagaaatcaagaaaagaatggttggatacaacattaaaatggagtaaaactcctgtagaagatacatattacaaaggtaacttacatcctggtgatattgtaatgacaagttgcggtatgatggataagaaacctatttttgttactgatgtaggtcaacatcaaatgtgggctgcacaatatttaaaaaatgtaaaaccggttaaatttttaacaagtggcggacttggaactatgggatatagttatggtgctgccattggtgcccaagtaggatgtcctgataaaagaatagttcaatttgtaggagatggttctttccatatgtgcttaaatgaagcatgtacggctgttagtcaaaatttacctattataacaattattatgaataatggtgttcttggaatggtttatcaatggcaaacagtattttatgataaaagatattctcaaactatattaaacagaaaaacagattttgttaaattagctgaagcttttggtttaaaagggtataaagcagaaacattggaagaatttgaagatgtatttgaagatgctttaaaacaaaatggtccggtatggattgattgtagaattgaagaacttgaaagagttttacctatgatacctaatggcggaaccattgatgatatgataataaattaaaataaggagaatgtaagatggctgatagaaaagaagttgtaagtattttagttgacaatcaatctaatgttttaactagaattgtaagtttgtatggaagaagaggttttaatattgattcgttaactgtttcagcgacaaatcatcctgatatttcaagaataacaattgtttttaatggtagcgatcaatctttatatcaaattataactcaaactcaaaaacttgaagttgtaagagatatatttgttttagatgcaagtaattctctttatagagaacttttacttgtaaaaattaaaacagataaaacagaaagaacatcacttaaagaaatcgttgatatttacagaggtaaaataatagatttatctaaagaaagtatgattattgaattaacaggtgctcctgaaaaattagatggatttatgaaaatgatagattgttatgatgttgtagaagtttgtagaacaggtataacaggaatttcaagagatttaagagaaatacattaataaataaacgacaaagggagaagacaatgaagttaagaagcgaaaatgtaacaaaaggcttagaaaaggcgcctgctagaagtcttttctatgcaatgggatatacaaaagaagagttaaatagacctcttataggggtagtaaacgcaaaaagtgaaattgttccgggtcacattcatttagataaagttacggaagctgtaaaagccggaataagaatggcagggggaacacctatagaagttccttcaattggtgtttgtgacggtatagcaatgggacatgcaggaatgagatattctcttccaagtagagagttaattgcagacagtgttgaaacaatggcaattgctcattgctttgatggtcttgtattggttcctaactgtgataaaatcgttcctggaatgattatggcagctgtaagattaaatataccaacagttgtatgttcaggtggtcctatgatgtcaggacttgtaaaaggagaagaaacttctttatctaagatgtttgaagcagtaggagcaagaaaagcagatttaataaatgatgatgaacttttagaatatgaagaaaatacttgtcctggatgtggttcatgttctggtatgtatacagcaaacagtatgaactgtcttgctgaagctattgggattgctttacctggaaacggaacaattcctgctgttgaaagcggaagaataagacttgctaaaaaagcaggtatggcaatcatgaatttagttgaaaaagatattaaagcaagagatattatcaatgaaaaatcaataagaaatgcacttgcttgtgatatggcacttggttgttcttcaaacagtgtacttcatttgttggcaatagcaaatgaggcaggtgttgaattaaaccttgaaatattcaatgaatttagtgcaaaagttccaaacttatgtcatcttgcaccagcaggcggaactcatatgcatgatttaaacagagccggtggattaatggctgttttacatgaacttgataaaaaaggattagttgataaatcattaatcacagcaaacggtaaaacagttggtgaaaatattgaaggtcatgaaattaaagatattaacttaattaaaacagtggcttgtccatatagcgaaacaggcggtatcgcagttatgtggggtaatatcgctcaagaaggttgcgttgtaaagagaagtgctgttgatgaaagcatgcttaaacatagcggtccggcaagagtatttaatagtgaagaagaagctattgatgcaatatataatggaaaaatcgttgatggtgatgttgttgttatcagatacgaaggacctaagggtggaccaggtatgagagagatgttaaatcctacaagtgcacttgcaggaatgggacttgataaaacagttgcattaataactgatggaagattctctggagcatcaagaggtgcttcaataggtcatgtttgtcctgaagcttttgcgggtggaaacataggtttaattgaagaaggggatattattgaaattgatataccagcatctaagattaatgctaaagtaagtgatgaagaatttgataaaagaagagaagcttacgtttgtccgaaagaacctgttaaaagcggatggcttgcaagatatcaaagaaatgtgtcttcagcaagcaaaggtgctgtaatgaaataagaaattaaattaaaaagagatatatttgatatatctcttttttttattatacttttaaattttttaaaattaagagcaaaaaaagaaaccatttaggtttctttttttatactctttcacttactattctaaatccgttttctgtaagttctttttcaatttcttttgcttgttcgctgtcttttgtttccattgtaatcttaatgaaacaactgtttataggcatttcaggatctccattgtcgtattgaactcctacaacgtttgctccacatttgcttattatgttacttactccaacaagttgtccaggtttatcagtaagagcaattgtaagagcactttttcttccgctcattacaagacctctgtcaattactctgtttaaaatgttaacatcgatattaccaccgcttacgatacaaacaacattcttgtttttaagtggaattttattaaacattgctgcggcaacagatacggctcctgcgccctctgcaacaagtttttgtttttccattaatgttagtattgctgctgctatttcatcttctgttacagttataatttcatctacatattcgcttactaattcgtatgttaaatctccaggttccttaactgcaataccatctgcaaatgtatttactgtttctgttgcttgtctttgatgttcttttacagatttatacatacttggagcacctgcagcttgtacgccatatattttgcattcaggttttaggtgttttatggcataagcaacaccacttataagtccgccacctccgataggaattacaactgcgtctacatttgcaagttggtctaaaatttcaagtccgattgttccttgacctgctattacatcttcatcattaaaaggatgaatgaaagtatagccttcttctttttgtagttctaatgccttattgtaagcatcatcataagtatcacttacaagacaaacttttgcaccatagctttttgttgcttctactttgcttattggtgcgccatcaggcatacatataatgcaaggtatattgcttttttcgctggctaacgcaacgccttgtgcgtggtttcccgcagagcaagctataatgcctttttccttttcttcatcttttaattggcttattttataataggcacctctaattttgaagctacctgttgtttgtaaattttctgtttttaaatatatattatttttgtcactaagagcgggtgcaataattaagtctgttttccttattacatcttttagtgtaaatgctgcatgataaactttatctaatgttaacattttaaccctccttataaataaaaatctattaaattacattatatattattttctgaaaatttcaaatatttttaattaaatatttaaaaaagaaaaatttagtgatatactcttattatatttttttataggagaagaaaaatgcaacacacattaaaaggtttaaatgaaaaactggattcattggcagtttttagaaatattttaaatacagatgttataaaaaatttaagaatattattagatactattcttgaatatgaagatgatgaatcaatggtattcgcatatagtgaatttgtttcatgtctttataattatgattttgatttttcaaaatacatatttaattttatattaaatgatgaaaatttttatataaaagctaaggctgcaggtaagaatgttcctgattttatagaaaactgtgttgatgaagaattaaatattcttgatgatttaagtaagttaacacctattgaaataaaagagtttatttcttatgatggtttcctaccagcatgggaaaatactatgcttgatttaaaagaaaaatataaggaaaaagtaaattctttaactgttacgggttatggaatatatgcaaaatatacggcttttgttcttgatgacgataaaatagttcctgtaaaatatcctgattctcaaagacttgaagatttatttggttatgaaagagaaagagatttgataattaaaaatactaaagctcttcttgacggtacaggtgcaagtaatatgcttttatatggtgatgccggaacaggaaaaagttcaagtgtaaaagcagtctgcaatcattttaaaaatgacggtttgagacttcttgaaataaagaaaaatcagttatataaaatacctaatatagtagatgagcttgcggcaaatccattaaaatttgttatatttattgatgatttaagttttaccggtaatgacgacaatttttcggctcttaaagctatattggaaggcggggtatctgctcttggcaataatgttgctatttatgcaacaagcaacagacgtcatttggttaaagaaacaatgtcagaaagacaaggcgatgaaattcatagaaatgatacacttcaagaaacaatgagtctttctgcgagatttggacttaccataactttccaaaaacctgataaaaaagcatatttgaatatagttgaaaatcttgctaaacaatacggcgtagagatggattttgatgagttatttacaaaggctgaggcttttgcaataagacacggtggaaggagtgcaagaactgcaaaacaatttgtagagcttgtaaaaataggaatataaaaaatacccttatgggtattttttatttatgaattatataatcaactggaatgtcatattcattataaggtaccttttcaattatttgctcattaaagcatactcctatttttaatgcatttaattctttgtttgcaaaaaatttatcgtaatatcctccgccgtatcctattctgtaattatcttttgcgaatactattcctggagttattacaatgtctaaaatatttggatttgtaattcttataaattctttctttggttcgaggattccataaaatcctttttcaagctcatcaaaggatttaagtttagaaatattcattattttatttttgctatctattattggtatatatatgtttttattattttttaacatatatttaataaatttatgtgtatcaacttcatttttaaaactcacgaaacacataatatttttagaatttttaatatctttattatttattaattcttcaaatattaatttgtttttttcttctctactatgtaggtctttcaatttaagttgaattttttctcttaaatcttttttattcatttttactccttgtaatttcctcttaataattctatttcttttttatacccatccatatcgtttggggtttccaaaaagaatggtaaatgctttaatgcgggatgattaacaaatcttattattggttctaattttaaaaagccttctccgattttggcatgtctgtctttatttgtattgaagtcatttaatgtatcatttaagtgaattgcttttaatctatcaagtccaatgattttatcaaaatcggttaaaactttatctaaattatttacaatatcataacctgcgcagtaaacatgacaagtatccaaacatactcccattttatctttcaagtttactctgtcaatgatttctcttagttcctcaaaacttctcccaatttcgctgccttttcctgacattgtttcaagtaaaataaatgtatcgtcatcttcctttatacattcatttaaaatatcggtaattcttgttattcctatttcaacgttatctgttgtgtagcttccaggatgaaagttatataattttgaagggatttgattcattatatctaaatccattctaaatatttcttttgcagcttctctcacatcttcttttgctgatgccatgtttagagtgtatggagcatgagcaagtattggggcaaaattattatcttctattattttttttaaagcttcaacatctttttcgtttaattcttttgattttcctcctcttgggtttcttgtaaaaaactgaaatgtatttgcatttatttttaaagcttcttctcctgcttttttatatccttttgctattgatatgtgtggtcctatatttaacattttattctcctaaaaattttattataattaagtataagaaatttataataaaaatcaaacaattattataaaattaatgtggttttattttaaataagtacttataggaatgtaaattatttgaatattctgtatttttttgatataatactataagtatatttaattgggaggtacgctgttttgaagttatcagaagaacaaaaaaaggtttgtaataacataatagaatattatgataataacccatctaatttgcttcaaattttattaaaaattcaaagacaaattccgggaagatttataaacttggatacagctgagtatatagcaagcaagatgaatattcctcttagcaacgtatcagaagttgtaacatattttgatgcgttaagtactgaaaaaagaggtaaatacatacttggtttatgtaatgcaactgcttgcagtttaaacggtaaagatgaaataagagaaatttttgaaagagaacttggtattaaagcaggtcaaactactgaagatggtttgtttacattggaattggttccttgctttggtgcttgcgacattgctcctgcggttagggtaaatgacaatgttgttggaaaattaaatgaaaagaaagttaaagctttaattgctaaattaaaggaggctaaataatgggacaagtaaaatatatttctaaagattatggaacatatgatgccttcaatattgatgaatatataaaaagaggcggttttagcggacttaaaaaagctattgaacaaggatatgaaaagactacagatgatgtagctaaaagcggacttcaaggaagaggtggtgcaaactatcctacagggaaaaaacttgctcaggcaagagaagctgttggagatgaagaaagatatgttctttgtaatgcagatgaaggagaaccaggaacatttaaagataagtatttacttaaaaacggtatatataaagtaatcgaaggtattataattgcagcttattgtgcaggagcaaataccggacatatttatgtaagagaagaatatacttttatgcataaagatattgaatatgcaataaaacaagtttatgataaaggatttttaggtaaagatattttatcaagcggttttaattttgaattatctcttttctcaggcggtggttcttatgtttgtggtgaagggtttgcaatgtgtgaaagtattgaaggaaagagtggaagacctagaagtaaaccaccttatgtaaaacaatgtggtctacatagtaaacctactcttgtaataaatgtagagacagtcagtgtaatagctacattaatgcaaaacggatatgaaacagtattaaaatacggtgttgaagactgccctggaacaaagatgataagtgtaagcggaaaggttaaaaatcctggtgtttatgaagttgagtttggtacaaccgttcaaaatattataaaaattgcaggtggaataagaaacgataaacaacctaaattcgtacaacttggtggtgccagcggaactatagtaccttatgaaaaacttaatattccttatacatattcgggaatgaagaaagtaaaaggaagtattggttcaggggctattgtagtcggagatgaagatgatagcgtaattgattatttatctgttgttgaagattttttctatcatgaaagttgtggtaaatgtgttccatgcagagaaggtaacagacaacttaagatgattatggatagattcaagaaaaaagaaggtactttaaaagatttaaaaaactatgtaagaatagttaatgctttggatgcgtcattatgcggaagcggtagaactcaaattacaccgtttatcagtgcatatacttatttttccgatgaatttaagggtgcacttaaaggggaggaatagaagtgataaatttaactattgataataaaccagtaagtgtaaaagaaggtacaacaattttagatgcagcaaaacaagccggtattgaaattcctacactttgttatttgaaagacgtaaataaacctgcttcatgcaggatgtgtatggttgatgtatcaggcagactttctccttcatgtgtaacacctgtatgggaaggtatggatgtaaagactcagacaaaaaaattgagaaatataagaaaaactatacttgaattaactcttgcaaatcataattgcgattgtacaatatgcgataaaagcggtaattgcaaattacaaactttggcaaatacatatttgacaggtccaagtgattttgaaacttgttttgaaaaaggttttgatgattcttcaaactgtgtaacaagagattatagcaaatgtattaaatgcggaagatgtgtaagtatttgtaaagataaagttggtgcaaaagctatttcttttgtaaacagaagtgacagtacaactgtatccactccttttgatattcctgtaataaacagcgattgtataggatgtggtcaatgtatttcagtttgtccgacaggtgcattggtagaaaaaggaacaactgaagaattatattatttgttaggtgaagatacttattacaatatttgcttattgtcatatggcacatatgaatctttatcaaaaggtttaggtgtggatgatgcacttattaaagcaaaagttgttgatgttttaaataaacttggttttagcgaagtaattgattatgaagaatatttaataaaagaaatgaatgctattgcatatattttaaaagaaaatatggctgaaggaaaatctttaatatatgcttgttcacctggaataagaaaagaaatagaagacgcttatcctgaagctgataattactttgtaaatcttccaaaaataagaaaagatatcaacatgaaatttaaagaagattacttagatagaaacatagataaagatgttcatttaacaagagttgaaaattgtactgctttcttaaatgaaaatgaagaaacaagtggtgttgatatatcaattactacaaatcaacttgtaaacttaattaaaacaagcggtattgatttaaataaagctaacaataagcctcttgatactcttgattatacaggaatatttaatccttatttcttaagcgtaaatacagcatatgctattataagacttggagataagtcttcaattaaaaatgataaaggtaatataaaggaattttcatttgaattatcagatggtaaagaaataaaatgtgctgttgtaaatggattaaaacagtctaaagaagaagttgaaaagattataaacaaagaaagcgaatacgattttgtatgtgttattccttgtgaaggcggatgtgttaacggtggaggaagaccagtagacgttaagtagtttaaataataaaataaaaagattattcatatatatgaataatctttttttatttggagggaaaatatgcaaattcattttttaagagaaaatgaaaatattgatgatttaagtatattatattcggtagaaaaaaataaaataatggaagcaaataaatttagaggggataagctaagagataagcaagtaattatcccatgtgatgatttttattattttaaaaagtatgaagagagtatagaaagtatacttagtaaatttgatatagcaaaagaagaattatattctttaaataaaagtcccttatgctttaaagacggaggaataaggttaaaattaaagcaaaagaaaaaaaatataaaagtgtattctttgatagatttaacaatggggagtaattgttttatagaggctgatttggaaaattcctatgtaaattcttttattggatataacacgacttatgatgaaaatgatgatatggaaaataataaagatgatattattgatatatttaaaaaactttctttaaaaataggaaaggaaaaaatgatattaagatatgatccaatttttataaataaaaaatatgatgcaaattttcatatattattttttgattatttatgtaaaactttaaagggttatacaaatactgttgttataagttttttagatatatataagaaaataataaaaagaatagaaaaatatgatataagaactttaaatgaaaatgaaataatgtatatttgcgaaaacatatcaaaaatagctaaaaagaataatatgagggtaaaaacatgttcagaaataattgatttatcaaattacggaattgagcatggaagttgtattgataaaaaacttattgaaaaaattatagggtgtgatttggatataaaaaaggataaaaatcaaagaaaagaatgtggatgcgttgaaagcatagatgtaggctgttatgatacttgtcaaaacggatgtatttattgttatgcaaatcaaaacagtaaattagtaaataaaatatcaaatttatataatgttaattcacctatattatgcgataaaataaatgaaaatgatataataaaaagacgtgaaataagatcatttaaaaatagtcaattgagacttttctaaaataaggagataaaatgaaaaatattttacttatagcagcaggcggaactattgcatgtataaacacagaaaatggattaatgccatatgttagggcagaagatattgtgaaatatataccagaaataaaaaaaatatgtaatctaacttttaaacagttatttaatttagatagtacaaacattcagcctgagcattggtgtcagattgcaaatgtaataaaggaagaatatgataattatgacggatttataattacacatggaacagatacaatgtcatatactgcatgtgcattatcttatttgattcaaaattcaaaaaagccaatagtaataacaggctctcaaaagcctattaacgaaacaataagcgatgcaaagaaaaatttaacagatagtataagcttttgtttagatgaacaaaattatggagtttatgtagtttttgacggtaaagtaattataggtacgagagcaagaaaagtaagaagtaaaagctacagtgcttttgaaagtatcaattatcctatttctgcatttattgatggggaaagaattgtaaaatatgttgaaaaaaatgaaaaagaaagcagtataaaattttatgattgtttaaaaccttccgtttttgtattaaaacttataccaggtattgaacccgatatacttgattatattatggataattatgatgctgtagttattgaaagttacggagtcgggggagttccttttcataataaaagaaattttcttgataaattaaagaaatatacaaaacaaggcaaaattattgttattacaacacaggttatgtttgaaggaagcgatgcaaagctttatgaagtaggaaaaaatataatgaaggaatataatgttttagaatcttttgatatgaccgttgaagctgtatgtattaaacttatgtggattttatctttaacaagtgattttaataaaataagagaacttttttataaaaaaataaattttgacatcttaacaaaagaaaattaaaaaattatgaaaaaaatgtaataaatgtttgaaattttcagaaagttcatatataataatatgcgtatgaaaatttaataataatttaggacaaaagaagtttgtaggaaaataggctttgccttaccgaaggagtaaaactctcaggtattcaaatttgaatgaggactataaacggatgtggctctggagaatctctatggagtgccgaaggtgcaagatgttttacattaatctctcaggcaaaaggacagagtataataaaattattttaatattttttattatgtaatgttattttatttagagtattagagtcaaatatgtttatttggctctttttttatcttttgttctttattggaaaggtgttttaatatgttggacaattttactgaacttcttgttaaaatcaatgactttgtatggggaactcctttgattgttttgataatggcagggggaatatttttaactttaagattgggatttactcaaattcgtaaactacctttggctttaaagtatatggtaaaaaatgaagaaggcggagacggagaagttacctcttttggtgctttgtgtacagccctttcagcaacaataggtacaggtaacatcgtaggtgttgcaaccgcaatatgtgcgggaggacctggtgcattgttttggatggagcttgctgcatttttcggtatggcaacaaaatattctgaaggtcttttggccgtaaaatacagagttttggataaagataatcatgctctagggggacctttttattatattgaaagaggaatgggtgaaaaatggaaatggcttgccaagatatttgctttttttgggatttgtgttggtttgtttagtatagggacttttactcaggttaatggtattgcatctgcagtgaataatttttttgaccctaatatggcatggactgttacaatacccggtataggaacatattcttggacagttgttatttcatctttgattcttacagtttgtgttgcacttgttttaataggaggaattaaaagaattgcaagtgtatctcaagttgtcgtgccgtttatggctgttttgtattttgttgtttgtcttattttaatgatatgcaatataactgaaattccaaatgcaattatggttataataaagggagcatttaatccttctgccgtaactgggggtatagttggtagtatgattattgcggtacaaaaaggggtcgcaagaggtattttttcaaatgaatcaggtcttggatctgctcctatagccgcagctgccgctaaaacaaaagaacctgcaagacaaggtttggtttcaatgacaggaacatttatagatacaataataatatgtactatgacaggattatctataatcttgacaggagcgtggcaagtgagtgggcttgaaggagttgaagtaactacatatgcatttaataacggacttcctttttctccacaaatatcatcatttatattaatgatttgtcttgtattctttgcttttacaactattttaggttgggattattattctgaaagatgtcttgaatatttaaacggcggaaacaaaaaagcattacttacatttagatggatttatattttagcaatatttattggtccatatatgacagtaaaagctgtttggacaattgctgatatatttaatggtttaatggcagttccaaatatgattgcactatttgcattaagcggtgtagtcgttagtgaaacaaagaaatattttgataaaatgaaaaaagaaaaagaatctaaagttgaggcttagtaattttaaaagaaagagtgaaaactctttctttttttttgcttaagttgctttgttgacaaaaaaatttttttatcatagaattaaaaataataaaaaattatataaaaatgtgttcgtgtttatggaatgggaggtgtaaatatgaatacagttattacaataggaagagaatacggttcaggaggacgtcttatagcaaaaaaagtttctaaacttttagatattcctttttatgatgaggaacttataaatttaattgttcaagaaacaggtcttgcagctgattttataagaaatgctgatacaagaaatccaataggatgtttttcaaatttgagttttagttatgataatttacctgttgagggacagcttcttgtttcagaagcagatattataaaaaaagtggcagataaaggaccttgtattattgttggtctttgcgctgactatattctaagacacaaagaaaattgtgcaagaatattcgtaagtgcaccatttgaagaaagagtgaaacgtgttaaggaagattatcacgtagaacaaaaaaatattgaaaattatgtaacaaaaatagataaatctagagctaaatattataattatattacagatgaaaaatggaatgtagcaaaaaattatgatatggttttaaacagcacaataggtttggatgaatgtgcacagctgataaaagcgttagttgaaataaaggagaataaagcttaatggatgaaaaagagcttgttatagacaaaagaaaagagaataaaatgggggtaatgcctgtaaacaagttacttgttactatgtcacttcctatgatggcatcaatgcttatacaggctttatataacattgttgacagtatgtttgttgcgatgttaagcgaaaatgcattaactgcggtatctttggctttcccgatacaaaactttatgattgcagttgcagtaggtacgggagtaggtgttaatgcttatttatcaaaatgtcttggagagaaggagtttgataaggcaaatcaagctgcaaaaacagcaatatttcttgcagcaattaattatattatatttttaatatttggaatttttggttcaagagcctttttcctttctcagacaaatataacagatattgtaaatgacggaacaatttatttaaccatatgtaccgttttatcttttggagtattctttcaaatagcatttgaaagactgttacaatctacgggaaaaacagtttataatatgtatatgcaaggtcttggcgcaataataaatataatattagaccctataatgatatttggtttatttggatttccaaaaatgggagttgcgggagctgctcttgctacagtaacgggacaaattatagctgctattgttgggtttttgtttaatcattataagaatcacgagatagatataaatttaaagggatatagacctaatttatccattataaaaaggatttattctgttggtattccttcgattatcttatcatctttatcttcagttatgacctttggaatgaataagattttaattacattttcatctacggcaacagcggtttttggagtatatttcaaacttcaaagtttcgtatttatgcctgtgtttggattaaataacggtatggtacctattatatcgtacaattacggagctagaaagaaagaaagaataatgaaaactttcaaacttagcattttttatgccgttgggattatgtttgtaggttttttactattcttgttcttcccaaaagaacttctctctatatttaatgcttcaaatacaatgatgagtataggtgttcctgcacttagaataataggaataagttttgtatttgcaggttttagtatttgtactctttctatgtgtcaggctttagggcatgggttggaaagtttacttatatcaggaataagacagcttgttgttcttcttcctgtcgcttatgtgctttcaaaaataggaggacttaatttaatatggtggtcttttccttttgcagagattatcgccgtattcctttgtgtcttcttcttatcgagaatataccaaaaagaaattaagaatttataaaataaagggtatttaccctttattttttttaacgttttttcatcatatttcatattatatataaactctcaaaaaggaggttttgttttggtaagaataagtttatgtatgatagtaaaagatgaagaaagtgttttaaaaagatgtttaaaaagcattaaagatattgttgatgaaattatcatagtggatacaggttcgaaggatagaacaaaagaaattgcaaaagaattcacaaataaaatatatgattatgaatgggtagataatttttcaaatgcaagaaatttttctttttcaaaagctacaaaagaatatattttatggcttgatgcagatgatgtaatacttgatgaagataaaaagaaattcataaaaatgaaagaaaacatgagtaatgatatagatgttgtaatgatgaaatataatacgtcgtttgatgaaaatggcaatgtcattttttcatattacagggaaagattaataaaaaatattcataaggatatgtggaacggttatgttcatgaggcaatagttccttttggaaaaatagaatattctaatattgccgttactcataaaaaaataaagaaaagctacagtgacagaaatataaaaatatttgaaaaattattaaataacggggttgttttttctccaagagaactattttattatagcagggaacttctttatcacaataaatttaataatgcaattgatggatttgaaaagtttttaaatatggataacggatttttggaaaataaaattgatgctttaaggatgatgtcttattgttataaaaatataggacaaacagataaagaaattgaagtattgtttaggacatttaagtatgatactccaagagcggaagtttgttgtgatataggaaattattttgttaatataaatagatacaatgatgcaatttattggtataaatcggcacttaattgtagtagaaaggatactttagggggatttattttagaagattgttatggatatattcctttaattcaactttgtgtatgttatgacaaaatcggtaacacaaatttagcaaatgaatataatgaattagcaggcattataaagcctgctggtagagaatatatgataaacagagaatactttaaaaatatattttcttaaaagtaaaataaggagtgaaaatataatgtatgattttgattataacagttttttagaaggtaacgataattcaaattgttgtaaacattctaaaaaaaataattcatgcagtatgaaatcaaatgaatattatccctatacaaataataatcaatcttcttgctgttatactcccaaaagtcataattgctgcgtagtaaccggcccaacgggggcaacaggagctacaggtccgagaggtccaagagggtgtccaggaccaacaggggcaactggtgcaaccggaccacaaggaccaaatggtaatagtataataggtcctacaggagcaactggtgttacaggtccaacaggcccaaccggcccaacgggagctacaggagcaacaggttcaggggcgacaggtccaaccggcccacagggaccacaaggacctcaagggatacaaggtcctacaggtgcaggtgtaacaggagcaacgggaccaacaggagctcaaggtccccaaggtccccaaggtgttcaaggtcctacaggagcaacaggtgttacaggtccaagtggagagactggtgttacgggtcctacaggagcaacaggtgttacaggtccaagtggagcgactggtgttacgggtcctacaggcccaacaggaccaacaggtccaagcggagtaactggagttacaggttcgacaggcccaataggaccaacaggcccaagtggagcaactggtgttacgggtccgacaggcccaacaggcccaacaggtccaagcggaaataacggtcaagctgctacattaagtgttggaacagttacaacttctgcgcctggtacttctgctactgttacaaattcaggaacacctcaaaatgcggtttttaattttgcaattccaaggggcgcaaccggtataacaggagcaactggcgcaacaggtgccacaggcgcaagcagtttggataatcctcaaatattatgtgcaattgattctgcaccacaaccaacaaccgcaaatcaacctattcaatttaacagtaattatttaagtagtggtagtgcaataactcataatacaaattcaaccaatataacaatttcgcaaaatggtatttatcaagtaaactttaatgcttctgcaggaacttcaggttcttcttctgcaataagtattgctttatataaagatggaaacgcagtaaatagtgcagtaacaagacaatcattgtcaggttccggtaactatgcaaatatgtctttttctacaccaatttcagttacttcaacaccttgtgttttaactgttgttcctgacagcagtggttttactttaagtgatgcttcaattaatgtttataaaataggaaatgtaagcagtaattaaatgactaaataaaatgttttatgtaaattattgacttaaaaataaaaaaatgttattctattttatgttatacgactgacggaatagtggaattaaccacatgaagtataatgattattatgagccgaccgtctgggcaagagtccggattggtgggctatttattgttttaggagtgtaacaaatgaaagaaatacaattaaagtatggatgtaacccaaatcaaaaacctgcaagagtttatatggaagacggagatttaccgattacggttttaaatggtaatcctggatacattaatcttcttgatgcttttaacagctatcaattagttaaggaattaaaagaagcaacagggcttccttctgcggcatcttttaaacacgtttcacctgccggtgctgcggttggtttggaacttgatgaaacattgaaaaaaatgtattttgttgatgaaaacataaaacttacaggtatagcaaatgcttatataagagcaagaggagctgatagaatgtcttcttatggtgattttgccgcattgtctgatgaatgtgatgaagcaactgcactttatttatcaaaagaagtttctgatggcattattgctccttcatattcaaaagaagctttagaaatattaaagaaaaagaaaaaaggaaactatcttgttataaaaaatgataaaaattatgttccaaaagaaatagaaagaaaagaagtttttggtataacttttgaacaaggcagaaacaatataaaaataaatgaagatatgcttgaaaatattgttactgaaaacaaagatatgactgaaagtgcaaaaagagatttaataatttctttaataactttaaaatatacgcagtcaaattcagtatgttatgtaaaagatggacaagcaataggtataggagcaggtcaacaatcaagaatacattgtacaagacttgcagggaataaggctgatacatggtttttaagaagccacgataaagttttaaacttaccttttaaagaaggcttaagaagggcagacagagataatgctattgacgtatatatttcagaggaacatgatgacatattaagagacggaagctgggaaaatgtatttactaaaaaaccagaagtattaacaatggaagaaaaaaaagagtatttagctaaaatgacagatgtatgtcttggttcagatgctttcttcccatttggtgataatatagaaagagcatataaaagcggagttaaatatattgctgaagcaggcggctcaataagagacgataatgtaatagatacttgtaacaaatataacatggtaatgtcttttatcggtacaagattattccatcattaaagataacctcaatatgggttatcttttttttatatttacttgtttgttattgctaacatggtgtataatatttatataaaaaaagatatttcctattgacattataggattaagtgttatactttttttagaataattagcatatgttaaaaactctaaatagaaggagcatgttatgaaaaaggaaaaatatgatattaccggcatgagttgttctgcttgttcgtcaagaatagaaaagacattaagtaaaaaagacggagtagaagaagtaagtgttaatcttcttacaaacagcatgaatatttcttatgatgaaaatatattaaatactgatgatatagtagctgaagtaaaagaaataggttatggtgctaacgtacatggggaaaaatcaggtgcttcaaaagttaaaaaagatattagtataaataatgatgatgaaataaagtatatgaaaaaaaggcttataatttcattttgttttttaattccacttatgtatattgcaatgtatcatatgtttgacggtttcttaggtttaaagacacctgattttataatgaatttatttcatggaagtaaaaatgccataaattttgcttttattcaatttttactggttttacctataatgtatatgaacagaaagtattatactgttggatttaaaacatttttcaaaggtagtccaaatatggatagtcttattgctattggttctatggctgctgttgtgtatggtgtttttgcaatatttatgattggtcatggtcttggttatggagatttggaacttgttaataaatatagtacaaatttatattttgaatcaggaggaatgatattaacgcttataactttgggaaaatttttggaaacaaagtcaaaggggaaaacaagtgaagctatttcaaaacttatgaatttagctccaaaaatggcagttgtagaacgaaatggagaagaaatggaaatatctgccgatgatgttataaaaggtgatattgtaattgtaaaacccggaagcagttttcctgttgacggaataatcgtaaatggaaatacaagtgttgatgaatcaatgataacaggagaaagcatacctgttgaaaaatcagtgggagataaagtaattggtgcaacaataaacaaatcagggtttgtaaaatttgaagcgactaatgtaagcgaagatactacaattaataaaattataaagcttgtagaagaagcaagttcttcaaaagcccctattgcaaaaatggctgataaaatagctggagtgtttgttcctgttgttataactatttctttaatatccatgatagtatggttacttattggtcaaagctttgaatttgctttgtcaatagccatttctgttttggttatttcttgtccttgtgctcttgggcttgcgactcctgttgcaataatggttggaaccggtaaaggagctcaaaacggaatacttataaagtcaggggaagctttagaaattgcacatagtatagataccgtagttcttgataaaacaggaacaataacaaaaggagaacctattgttacagatgttttaaattttgatatcccaaaagaagaacttttaagcattgcatattctcttgaagtaagcagtgagcatcctcttgcagaatcaatagttaaatatgctaaagataataatataaacactattcaaaatgaagattttgaggctatatttggaaaaggtgttaaagcaaaaataaattcaaaaatgtattttgcaggaaatgcatctttaatgaatgacataaatgtagatatatctatatatgaaaaaacaataaatgctcttgcggatgagggaaaaacacctttaatttttgcaaatgaggaagaggtaattggaattattgcggtagctgatattgaaaaagaaagcagtaaagaagcaattgagaagtttaaaaatatgggaatagatgttgtaatgcttactggagataatgaaagaacagcaaaagcagtgcaaaaaaggctttctattccaaaagtaatagcccaggttttacctgatgaaaaagaagcaaaagtagtaagtattcaaaaagaaggtaaaaaagttgcaatggttggagatgggataaatgatgctcctgctcttgccagagctgatgttggtattgccataggtgctggaactgatgttgcaatagaaagtgcagacatagttcttatgaaaaacagtttacttgacgttgtaaatgctataaaattaagtaaagcagttataaaaaatataaaagaaaatttgttttgggcatttttctataatagtataggtatacctttagcaagtggattattttatacagctttaggatggaaattaaatcctatgtttggtgcagctgcgatgagtcttagcagcgtatgtgttgtaacaaatgcattaagacttaaatttataaagtttgataatgaagataataaagatgaaaaaggagaagaaacaaaaatgagcaaaaatgaaaaacaacttgtaatcgaaggaatgatgtgtcctcactgtagtatgacagttgaaaagaaacttaaagaaattgatggtgtagaggaatgtagtgttgatttagacaaaaaaagtgcttatgttacattaagtaaagatattaatgatgaagtatttaaaaaagttatcactgatgcaggatatgaacttattgaaataaaatagtaagtaaaatgaaaacattaaaaaagatatttgtttttataatatgcttttgtatccttgtttccttttgttctttcaaaaaagatatagatgctgattcaaattatgaacttggattatcgtactttaaaaaacaggatttttataatactattgaaacattaaaagttataactgacaataatttatctttaaataaacataaaagtgatgaagcaaatatgtattatatgataggctattcatattggcagttaaaaagatttgatactgcaactgcatatatggaaaaagcaaatgaacttgataataacaatgaagaatataaacaagttatgggaagactttattatattgttgatgagtttgagaaatcaagacaatgttatgaaggtgttttaaaaataaacagtaaaaatgaaaaagcatattataatcttggactgatatccttaaaagaaagtcctatggatacaaaaaatgcaaaaaattactttgaaaaagcaaccaatttatatcctgaatatgcaatggcttatgcaggaatggctatggcatattattttgaaggaaataaagaaaagacaaattattatttacaaaaagctattgactttggatataacgatttaccagtcataaaacaaattcaaaatggagaattaaccaaaccgtaaaaaacacagaaatattctgtgtttttttttattttttaagaaataatataatatatttaaagaaaaaaataaaaaaattttgcattttatgtaaaatttaagtaaaataaatataaatacatagtaaaataaatttaaaatatgatatattatttaagatttttttaattttatataagaaaaacggagataatttatgtttaatatagttttatttaatcctgaaattccacaaaatacaggtaatatagtaagaacctgtgctgtaacaaattcaagacttcacttaattaaacctttgggttttagtataagagacaagcatttaaaaagagccggtcttgattattggaatgaagcagacatacaagtttatgaaaattttgatgattttttggaaaagaatgatataaaaaatttatatttacttacaacaaagggagataaaaattattcttcttttagtttttgtgataatgactattttatgttcgggtctgaaacaaaggggcttccggattttatacacgaaaaatataaggatacaagactaaggatacctatgataccaaaagagaatgcgagatgtttaaatttatccaacagtgtttgtgtaattttatatgaagccttaagacagacagaatttaaacatatgaaataaaacaaactaaaaattaaatcaaacatttatgttattgggaggaaattgttatgagtgttatgatgttaatccagcttttcggaggtcttgggctttttttgtatggaatggatttgatgggggaaggattaaaaaaagccgcaggtaataaattaagagatattctaaataaagttaccagcaaccctataaaagctcttgcacttggtactattgttacaatgattatacaaagttcatctgccacaacagttttggttgtaggtcttgttaatgcaaacttaatgagccttgttcaagctgcaggtgtaattcttggggctgatatcggtactacaataacaggtcaaattatagctttaaatttgtcagaatatgctcctttatttatcggtcttggtgcagcaataagaatgttttcaaagaaggataaaacaattcatataagtgaatgtatacttggttttggtattttattttttggaataagtgttatgtctgatgttttaaagcctcttgcaaataatcctgtatttacaaatatgcttataagtttaggcaaatatcctattttagggatgttcgcaggtgtgtttgttactgctgttattcaatcttcttcagcatcaatcggtttacttcaagcacttgctcttggtggtgcgtttgcaggtgtagaaggttatgaagctttaggcgttttaattccgattgttcttggtatgaatataggaacatgtgcaactgctatgattgcaatgataggtgtagacagacaagctaaacaagctgctgttttccatttgataacaaaaacaataggggtaatttggatgatgacattattattccttacaggttcattctctgcaaatggtgacagttttgtatttaactttattcttgatatttctggaagtgatcctacaaaacaaattgcaaacttccatacaatatttaatgtatgtaatgcatgcttattattattcttaagtaagcctataatatcatttattgaaaaaattcttcctgttaagaaagaaactaacgaagaagaaggttttgaattaaaattaaatgatattttgttagaaaaccctgcttttgccgtttcagaagtattaaatgaagtagaaacaatggcagagcttgcgtataaatcagtaaatcttgcttctgatgcttgtataaatgataaatatgacaatgaagaagaagttaaaatgcttgaaaatttaattaacaaatatgaaacaggtatcgcagattttgttattaagatttccgcattggatgcgagcatacaaagtgcagattttacggttcatttgcatcaagtaatacatgatatagaaagaatcggtgattactgtatgagtatgattagaatttctcatctaaaaaaagaagaaaatacagtatttagtgaaaatgcaacaaatgaacttatggaaatgtatgaaatggtaaaaaataatttaagatgtgctatagatgcattcaaggaaaaagatattgcaaaagccgttaaaacggatttggttgaagaacaaattgataaaaaagaagatgaattaaggatggcacatatagacagattaaatagaaaagcttgcacaccggaagcaggtgtagtatactttgacatagtggcagacttagaaagaataggtgattatactgcccatataggaagctttgttaaagaatatgttgaacttttatctaaaagacaatttgatatgcttccataggaggttaaaatgaaatatgatgtaataattattggtgccggtcctgccggactaagtgcaggtctttatgcttcaagggcaactttaaatactttaattatagaaaaagctgtggttggcggacaaattacaacaactactgaaattgaaaattaccctggagcaagcgaagtaacagggcctgagcttgttgacaaaatgaaagaacaatgtttaaactttggtgcaaagataataaatgatgaagttttaagcgttgagaaaaaagatgatggattgttttatgttaaggcaaacaaagatgaatatattgcaaaaagctgtattattgcttccggttcttctccaagagaacttggaattaaaggtgaaagagaatatagaggaatgggtgtttcctattgtgcaacatgtgatgcaatgttttttacaggatttgaagtttgtgttgtaggtggaggagatactgcgttaaaagaagcaatatatttaacaaaatttgcaaaaaaagttaccataattcatagaagagatgaatttagaggaggaaaaagctgggaaaagaaagcaagagaaaatgaaaaaatccatttccttttgagtcatgaacctgtagaaataattggtgaaaatggaatggtaacagcaataaaacttaaaaacaaaaaaacaggggagatttatgattataaaacagacggagtgttcatgtttgtaggtcataatcctaacagcgatttagttaaaaacatggttgaagttgatgaaaatggctatataataacagatgactctcttcaaacttcaataaaaggattgtttgttgctggagatgtaaggaaaaaatctttaagacaagttgttacagcggcttcagacggagcaatttgtgcaacaggggcagaagagtttattgatgaattaaattaaaaaagtgttattttaataacacttttttttatttatattttttattaaaatgatttataaatataaaaattaatattataaaaaacttgaaaaaaatatgaaaaaagcataaaataaatatattatacagatataagtataaataattaagaggttaaaaatgaaaaaatttattagcataataatggctttattttttgccctgacattgtttggatgtggaggaagtaaaaaagaaagcgcagtaaacagtaaaaatggtaaagaatataaaatagcatatatgactgatacatacggagcagaagaaagttttaacaaacaagttattgaaggtattaatgaatcttttggaaattatgaatatagtttggatatttatactccaaagacaaatactgaatatgaatcaatggcaacatcagttctttctgcttctcaatatgacctagttgtgtctaattcatcggctgtatgttctgctcttcttgccgctcaaagcgaatactcaggtagtaatttaggttttattggttataatgatgaaacaaataatgcaatgagtattacttttaaaaatgaagaagcagcttttttagccggagttctagcagcattggaaacaaaaagcaatgttttgggatatgtaggagcttataatgatagagatcttgattatgaatatggtttcttaagcggtgtaaaagcagttaattctaaaattaaagttaaaaaagagtatattaattcttatatgagtgctgaagaagcagaaaaggtagctgaaaaattatataatgaaaaagctgatgtagtatttaccgtatgcggagccggagcaataggtgtaaataatgttgctaaagaaaaaggctttaaagttattgattcagatttatataataaatctgataatgaaataaaacttgcacaaataaacaaggattataaaagtgcagtaatttcaatttgtgatgccgtaatctttgaatcatattcaaaaagttgtagtgatttaagtgtactagactctgtaatagatttaaagttaaatcagactttttttgatcaaagttcaaatgaatatactactatagaaaaagtaaaaaaagatatggcaacaaagaatttagttattccaacggacgaaaagtcttttaaggcttttaaatataacattaacgattaaggagagattaaaatggatataaaatatgaattggtagaacaaagaaaagtaaaaccggatcaaaacaatttaggttttggtaattattttacagaccatatgtttgttatggactatacagaaggaaaaggctggcatgatgctagaatcgtaccatatggtcctttagctgttgatcctgcaacaatggttttacattatgcacaagaaacttttgaaggtttaaaagcatacagaaatgaaaaaggtgaaatattattatttagacctgaaatgaatgcaagaagaatgattaattcaaataaaagaatttgtatgccaggtgtgcctgaagatatgtttattgaagcagttgaagcattggtaaaatgtgaaaaagattgggttcctacaaaagaagaaacttctttatacataagaccttttatgtatgccagtgaagcaagtgttggtgtgcaccctgcaaaaacatacaaattcattattattttatcacctgttggagcttattatccggaaggtgttaaccctgtaaaaatttgggtagaagatgaatatgtaagagccgtaaaaggtggtactggttttacaaaatgcggtggtaactatgctgcaagtatagccgcacaagttaaagcagaagaaaatggttatacacaagtactttggttagatggtgtacacagaaaatacgttgaagaagttggaacaatgaatgcaatgtttgtaattgacggtaaagttgttacagcagctcttgaaggttctgttcttccaggtgttacacgtgattctataattcatattttaaaagactggggttatgatgttgaagaaagagatttaagcattgacgaattaatggaagcaggaagaaatggaaaattaacagaagcttttggtacaggtactgctgccgtaatctctccaatcggtgaattatgttataaaggcgaaaaaatcgaaattaatggattcaaaacaggggatttaacacaaaaattatatgatactctaacaggtatacaatggggtaaattagaagataaatataattggacaagaaaaattaatttataatttaatatagaaaaggaaataaaaatatgagtgaattacttgctcctgctggagatttagaaaaattaaaatatgcttttacctatggtgccgatgcggtatatttaggtgggaaaagtttttcgatgcgtgctaatgcagggaattttacaattgatgaaattcgtgaaggagcacagtttgcccatgaaagaaataaaaaagtatatgttacaataaatattttagctagaaattatgattttattgacctttcaaaatatataaaagaacttgacaaggccggggttgatggtattattgccgctgaccccggagttattatgacaataagagatactcttcctgatatgaagatttcaatatctacacaacaaagtactacaaattataaaagtatggagttttggaaaagaaataaagttaatagagtagttttagcaagagagctttcttttaatgatgttaaagaagtttgtgctaataaacctgatggaatggaagtagaaatgtttgttcatggtgcaatgtgtatttcttattccggaagatgcttattaagtaattatttaactggcagagatgcaaatagaggagactgcgcacaaccttgcagatggaaatattctcttgttgaaagtacaagaccgggagaagaatttcctattgaagaacataaagaaggaagttttatttttaattcaaaagatttatgtttaattaatcatatacatgaacttattgaagccggtgtagatagttttaaaattgaaggaagaatgaagagcattttctatgtttcaaccgttgtaaatgcttatagaaatgctatagattcttacgaaagagatagagaaaattataaggttgatcctagtttatatgaagaacttacaaaagtaagtcacagacaatatactgaaggtttcttctatggaaatgctgattctacttctcaaaattatggaacaagttcatatacaagaaattatgattttgttgctcaagtaattgggtataacgaagaaaagggtatgtacgaaattgaacaaagaaataaattctttattggtgatgaacttgaacttgtaagaccaagagaaaaaagcgtaacatttaaaatttcagaaatgtataacgagaaaggggaagccgtagaaagcactcctcatccaaaagaaagattgtttattaaaaccgacggagttatattaaaagaatttgaacttataagaaaaagattataagtttttaaaaaatatgtacaaattttgtgatttgtgatagaatattcgtggtaaacatataaattatttattgaaggagaattatagatagatgaaaactaaagtacctgtaggtctttcaaataaacacgttcatcttagtagaaaagatatagatgctttatttggtgaaggctatgaattaactataaaaaaacctatttctcaacccggacaattcgctgcagaagaatttgttgatgttgtaggtccaaaaggtacgataaaaatgagagttcttggtcctgcaagacctcatgcacaaatcgaaattttagcaagcgatacttttaaacttggcgtacctaaagtaatcagagattcttgggatttagacggaacaccaggatgtattttaagaggtcctaaaggtgaagttgaaattgataaaggggttatagttgcaagcagacatattcatatgactatacctcaagctagagaatacggcgttaaagacggagatatcgttaaagttagagtccctggagaaagaggtttaatttttgaaaatgtattaattagatctaatgaaagatgtggacttgaaatgcatattgatattgaagaaggtaatgctgcaggatgtaaaaatggcgatatgcttgaaattattagagactaaaaaagactgcttatgcagtctttttttatttattgtttggagtcattgtcaaaatttcagtaccatcttttgtatctttcattttataaattattttatcatcttcataagatacttctccatatggaataccctctttagtatatttatattcaattgaatttaatttatcccacaaattggtacttactgtttttggattattattttgtctccatatagcagtttgtatcatatttgtatatcctgaatattttttaattaaagtttcatattcgttatcagattctgtattaatccaattgtatgaaatttcaattttttctatttctttataatttgaagaaggataaataattatttttaaatcatttttgtcatcaattacgagttcgaaataacctttactatcatcaaaagttacatcttcaagcaaatctattgttgtatcgttaaatttatttttaaatatactttcgtttatataatttgttgtacttaattcttttatctctgtactgcattcttttaaagcctttttacttcctttttcactgtcaaaaattctatcaagtatctctctttcataattaaactgcggatattcttcataattaacaatattatcgtaaaaaaattccccataagcctttaaatctgatgatgttgcttctattggactaaaaatatcaaatttagataaaaatattatcccctccaataatattataatcacaacagcaattatccctaataactttaattttcttttccccattttctttcccctttaattttgttattaatttattttttcatctttactatctatattttccaaaagattttttataatatttttatataaatgtattatcaataattctttctaatcaatcaggtatatttatattataaccttttaaatttttaattatttcatcagaatatttatccataaaatgtcctaaaaccacatccttaattgcatcaaaaactgcttcattttgtgctttttcagcatatttcaaagaaccatcattttctgctgaatgcattcggtcactatatgattcacctaaagatcttgctccaccataagcttttgctcctgcacctcctgtaaaaaaagtcattattgcatcttcaatacttgaatgaccagtatctaataaatctaataatatttttttcctttttgaacctttttctcgaattttattaataacactatttaacacagtatcatcaacaggtgttttattattcccaattattaggtttaatgtttgttttaagccatccaaagatctatttatttcattaataccgcctaatcccaataaagaaattcctccattattatttagaaaattataagcttcatcacttttatttttaacttgttcagggattaaataccttgcatatttatctgcaactttttgccctttagcttttgccaaaatatataccattttcctttgatcaacactcatattttctatatcatttaaactttgattactaaattcaggataaatgcttaatgcaagaggtgtttcaaacggtaaatcctgtcctccaaatttatttaaattatcttcaagcttatccttaccaaaatcgttttctaacttttcaacttctttatcttttattttatcactaatatatggaggattcaaattaattccaattttattcttcccaacaatatcgtctggaattgctttagcataatcaccgtaatcaactctattattcataatttcatttattgtttcatcaggaatagctgttttagtattttcctttaaataatgttttcttttataataatcagataatcttgtcacccataaagcatctctcaataattctttataatatttagcatcttcttctgatgatgttattactccatcatattttttatttaatgcatttacatcatttatagacatcttacttccgtaaataggatatacattttcaacatcttttacatgtttatcactactatcaacattttgtctaaaattacctacatctgatgatgaatattttttataatctgccattttttgatcaaattcatctttattaaacttgccatttggaacataataatattttgtaacaccatttgtaagcttactcatcttttctttatttgcctgcatctgttttcttaatacagctttttcatctctttgttttacaaaattgtttgcattatcatttatcctttgtatatcttcatttgttaccctgcttccataagttggataatctgaaaataaaacatcatttttactattcattccacttctttgatctactccatactgtctgtaataattatccattacatattttgaaacatcacttacattttcaattggctttgcatttgcctttttctcattttgtatctgctgtcttaataattctttttcatttctttgttttacaaaattatttgaattatcatttatcctttgtatatccgaacttgtcaccctgcttccatagcttggataagcttgatataaactattattctttgtatttacagcacttctttggtccattccataaggtttaatattacttgttacctgagatattccttgatctgtaatacccctttcattatcttcactttgatttttaaaaaccgtattctttttcttctgtatgctgttcataagactttccacgctttcctttgcttttgcgtctcttatgtttttcggcggtgcgctataaggatttatgccttttatgtaactttctattttccccttgtttatcttttctctgttttcttccgatacgttatattgattttcctttaaaagtgttggcttattgttcttcttcatatcaataccggaatatggatttgcctttaagtaaaaatcatctcctattttcgtatatgatttatccccaaaagttccacctctctgtcccatatatttctttacattataatcaaggtttatgttgctttcagaggaatttcttgaaccgtcaccatttgcaaacctgcttattgatgacccggctgagcttattgctccttttattcctgtacttccttttttataagaaccgcttttacctacagctctccctcctgatacatatgtgctataatttattttatatttatcttttttattactcattttactcctccttaaataaaaaaagacacgaaatgtgtcgaaaatttaattaattttttattttttgtaatattttaaaatttatgctccaaataaataattgtaaaattcaaatgaaacaatccaccactctttcaaaataaactccacttacatttaaccaccttaacgcataacctacaaaacattaaaaaccttaacctgattttaaccaccatgtcccactctttaaaatcaaaaccataaaacgcataaccgtttatttaaccaccatgttctattaccctacataaaatgccaaattggttaggctcggggtagcttttctgacagtaaaactcgggtagagttttacgcagtcatcgaaaagcgttaaaggccccacgcccagtggcgcccttttattcgacttttttaggcgagtaaaaaagtcgtggggttcttaaggggcaaagccccttaagaatttaagtgtattttatcaggcgacaaatttaaacttcttcttggctgtttacttactgtatttgaatttatgttccccatactgccaagtttgttcatgttattcatgccattactacccattccctttaaacttgcagcctttaatagtgcagaatttagggccgaagatgatgaagaagatgaaccttgaagtgaagaaggcatagtttcatctttatccataacagaagtatccatcatggctttttcttgttctcccttttgttgaattttcattatcttgtcttcttctttcttcctttcttttactatgttcattaatgcttcttttggtataacactgtcaacaggaagatttttcgcatactcttcaaaggttatatgaccgctgttaagcatatttccaagagctgtttctcttgcatatttatcaaaaggagtgtttggagaaatatctattttaatgcttacttttaatttttctattgtctctttgtcaataattctgcttacatagatttccttgtcttctcccttttggtctttttcgttttcttccatgttctctatgtcgtcatctcttccaacaatgaaattatttctcttttcttcgtttttaacttcacttaaaggtttctttattattattctttttccctcttttggagtgtacacctgccacatctcgaaaattatccctgcaacatcttcaagaaaatctttaaatctgattagttgttccgttaagttttgttcactgttttgttgaaccgccaaaatagcttgaccactggctctttccgggtttacatccccggtaacagaatctccggcacctgcaaggtcttttgtgttttgtataagctcatcttgaagtgacttactgtcgggactcatggttgcagggtttaagtatcccgcaacttttcttacgtcgtcaaccgtttgattgtctgtaaatattgcgctgcctacttttgtaatactgtcagggttactgattttcttgctgtcaacaacaagttttggataagcccccatcattaccgcaagagaccttcttgtagctgtcttgttgatctcaatttggtttggtataaggtttattacttcacccattcctctggcacttccttttaattcctcccaaacaaaatgagcaataggatacttcttaagtcctaaatctctctcttcttcaataactgcattttcggtggatttcttaaaccaaatgtgaccgtcttttttgaagaacttgcttattacaagaaccatgttgtgtaattcttcttttgcataatccccggcttgttcttttgttttgttgtcactcattatcttttgaatgtcatcttccgttaatttgttaagtccaagctctttgtttttccttgcaagtctttttacactggcaacactctgtcttgttgtgattaatatgtactcttgatcgttaatatcagagttgttttcattttcataataaatatttgtcttgtttacaacttccggaacaatctcattttcctctacatcatagtttaaataaagtataccctctgagttaatgcaggcatcttttaatatatcccttgaaattgcgttaattttcttgttctcccaaagaatcgaagtatattcgtttaatttagagcaaagatcagacatcttcacttgaaatctcgcatcttcaaagttgttgggagaaaatacaacgccgtatccgttaccgtttattacccccgttttgtatttaacaatcggtttaattatgttgtaagttataggagatataactccgctttcaacacctttccactgatctccgttgtaaaaacgataaaccttgtctgtttcttcatatacgtttttcttgcttaagaaatcctttcctttttcatataaggcccattcgcctgtctttctgtaattttcattttcatacataattcattctcctttattttttattcttagtattaatctcttattttttgtaatttcaataaactgctaaacttctgttatatttttaatctacacactctttttttacctgttataatatttctaatctccatccatatcccccttacatctaatacatcaaaagccataaccaacatttcaaattaatgttcaaatatcttacataaaaaatacaacgcctttatttatcttttatacaaacacctcaaacatattggggtaacggtagcttttctgacagtaaaactcgggcagagttttacgtagtcatcgaaaagcgttataaggcacttcgcctagaagtgtcctttttacctcttattgtgactgtttactgtttcaaagaaacagctgagtttttataaaaactcaggaagctgaaagctttaaacaacatgagcgatttttaaaaaaaattgcgaatggacaagcaaaaaaagagtggggttcttaaggggtaacaccccttaaatatggggtttaaggggcaaagcccctttgtattcacggcgtttgagtgaaagaattttgtccagtatttttttctttggaaaaatactggtcgctctttagagcgaaaccctaaaactccacgcctagtggcgcccttttattcgacttttttaggcgagtaaaaaagtcgtggggttcttaaggggtaaaaccccttaaataaaggttgttaagggagtatcccttaaatatatcccacctatataaaaaacctacaacctaaacagcttaggtcggggtagcattccagcactaaaaatacgggcagtatttttagtaagcttcggaatgcgttataagccttcacggcgtttgagtgaaagaattttgtccagtatttttttctttggaaaaatactggtcgctctttagagcgaaaccctaaaacgccacgcctagtggcgcccttttattcgacttttttaggcgagtaaaaaagtcgtggggttcttaaggggcaaagccccttatattaaactttcttctgccccctgcttgtaccgtcataattttcaatattgctaagtgcaatattcattttgtttaaagcttctttttcttcctttgtcatctttaccttgcttgtttttaaaaaaggtttaatactgtttctcttttcttctttcttttcactaacactttttaaaccgagattataagcaaaaagcaccatagccatgctaataaatccgtaaataattaaacatataataattaaattcattttcttcctccttttttgttatgtttaaaatctgtttcaaaattttttctacataccacacctccttaaaataaaataaaaaaagagcaaaaagctctttgtaaacaaaatttaaaatgagtaataaaaaaggagcataacgctcctaaaattaaaatgtattattaaactaaaatacaaactcaaatcatattttagctttaaaactaatatgttaaattataaaatatgtgctatttcactaataaacaaaactcacagaaatactttaacagctattagtatcattttacaaaattcttaaatatagtaacaataaaacactaaaaaacccctaacctaacatttaaccaccattactaactaactaacataaaatccattcaaaccctacaattccatttcacttctatgtcccacatctcacataaaacatcataaaccacaacctacatttttctaccatgtcccacaccctaaaataaacaccactaactaaatgtttagctcggggcagcggcagcactcgttcatagaaaaatcgggtagatttttcatgaaatccgagtgcgtcaaaggctccacgcccagtggtttccttttatccaaatatttggataaaaaatgtcccacccacttacatacaacgctaaattatatgggctcggggtagcattccagcactaaaaatacgggtagtatttttagtaagcttcggaatgcgttataaggcacttcgcccagaagtgtccttttttcctctttttttggacaagcaaaaaaagagtggagatcttaaggggtaacaccccttaaatatgaggatgccccttatttattattctcctcttcttccatcatttcttttacaatatcaggtcccttctttttctctggtggcttttctctttcaaaaatcatataatcagcttcacttccaacagccttttccaaatttccaaagaaataactataaaaatcatcatctatattaagtttataatgacattctccgttttcatcataatatgtttcataagttattgtcgtttttttctttgggtctactctggtttttgtagacatatctacatagtttctatatagattttcagtaaatatttctcccttttctccttccgtaagatatttttcttcactttcaatatcgtttatggtttcttcaagggctctattataaattttttcataatcaggactgtcaaatataagttttatttttttcttatccctatctattttctctatactaaagcctacactcctaaaagcaacttcaatatctttctctttatcccccgtagggtctgcaaaagtagacataacctcccttgcttcttcgtaatcactcggcaaatccccttttactatatcggtttttacatcttcaataagcccctttaattcttcataatatttaaattcatcacttactataagataatcacatggatttttttctatctcatatactaacccgcctgttagtgcactatataaatccatattaccgttttgtttcctaagaggtgctatagacatatctattccactatatcttccaacagacttatttaccatatttttatatactatattttctgtaattttatcattttccattacatttctgtattcttcttttaaatttttatttaacaaatcattcttttcttttttgttttttatgtttttctcttttatctgtttatcggttttctcttttgcatttttatatacttttccataattgcatgcgtaaacctttaaagtcacatcaccactttcaaaatcttctccatcttcatatttaccagtatcagtatcattatcattcaaagtaggttctattgttatgtttttataacatatttcaatccaatcttcaccaaacaatctttttaaaatttcccttgattcgttaagctcaggatactctacttcattttcaaaatcccagtaaaatttctttgaattaacttttatatcactgcaatattcttcgtctatatctgaaaaaaataattctcctatttcttctccaaaatttaacaatattgtagataatataaaatacattaaagcaataaaaacaaaggtaaacaacattctataaataaaatttttcataattttccctcgatacaaatttattataattatatcatattaataatcattttttataaatttaattttcatcctcattttctctatattccaaagatttattaaaaatattatattttgcagaattaaatatatcttttccgtgtttttttataaattgttttattcgtggatcttcaataccatttattaaatcatctatatttattgaaatattattttgtcttaaaacttcttcaacatccggatttatactaaaaagtaaaccatcattagcatcttcaaatgccatgctttgtgctttattcacatcatatacaccttcataattcattgcatcattataagtttttccccaagcaatagaataagataacattttaccaagccatggaaatcttattgtcaaactatcgatacaagtatctaccgtaacatcagcaaacccttccattacatatattattgctttttgtaaacctgtcccattatcctttaaatattctaaagcaacactttgacctcttctataggatggattaaaatttgtccccataacactgcctgtctgaaataatccttcaaaatctctatataaagtttcttcatatgcaattttaataagataatcatttccatatttttcaatattagcaagagtctcttcttttactctgtctgatacaaccaaagacattgcataaggtatcttatctctcatttctctatcataatcactatttcccatataatcactcattgcaacataaagcatttttctttcttcttctgtcatgctctgcataagagaaatatcaacatcttttaaatatggattttcctttaacgcttctgtattactaaaatctaaattttcagctccctttttttcaagcatatattctacagcaccgggctctccataatcttcaattaataaatccttagtttcttctccttccttagggtcaataaaaggatctattgcactaccatcctcagcataatattttctcttactaaaatctccatatcttggtgcatcttttgtatattcaatagaattatgaagattttcttgaaatgcacttttttgcatatttgcttccgattgtatcttcggctttataacatgttcataatacatatttgtagaattttcttttgtaaaatcccccggtcttcttggaacactattaatctcggaataagttttggtgctgttcataggttttgcattattcaaaacaggagcaaactgttcatgtcttttatttctatcttcaattctttttgtataatattcactacccggaccaaatttatttctataaatatccgttgttatatcagaagtataattcccataaggtcttacattattatttttcttttcttccggctctcttatggtttttgggtcataagattttatataagttttattattattttgatttataaaatccattcccaattttttattttgagtatatgtattgtgataagtcataaaatccttatttacatttgaattttgagtatagactttggattttaaattgttatcccctttatatactatgctgtcagtattgacttttttgtcattatttgtcgaattatacatattaccatttaaaccgctttttgaatatataggagcactcttttgttttaatattttagcactattttgtaatcctttatttatataattataactttgtttataaatatctgctacacttttatttatcgcttctttttgtatttgttccttttgttctttttgtttttgcatattataataattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttctttatttattgtttttatagaattactaattgttccggccgatttttttaatatttcatcaataaatttatttctcatttttccctccttttttatcatttttaaataaatttgatttctatatttctaaaataaacttcatttttatgtatctttcaaaatttttacctccttaaatacttaatttttttataaaacctagcaataaaaaaagagcataacgctcctaaaataaaattatattatcaaacttaattacaaacttaaatcatattctactgcctaaaaccaatattatgaatcatattctaacaacaaaaaactgtcatgataaatcttaagttataatacttgctatttcatcaataaataaaactaaaataattacttttatagtaataagtatcatttcaaaaaaatattaaataaactaacaataaaccacatcaaaatccataatcttaatttacataccatattccacagcattacataaagtaatgaaaccattaactttatattttaccaccatgacttgcaaattttcataaaatccattcaaaccctaaactcccatttaacaacaatgtcctaccccttctaaataaaagcagataataaggcaggttggggtagcattccagcactaaaaatacgggtagtatttttagtaagcttcggaatgcgttataaggcacttcgccgagaagtgtcttttttacatctataggacaaataaaaacacaacacctttatttatccatttatctcacccctataaaaaaactataacctaaacagctcggggcagcggtagcactcgttcatggaaaaccttgtagatttttcatgaaatccgagtgcataaaaggctccacgcatagtggtgtcctttttcccaaatatttggacaagtaaatatccctcacttctaagaaaaataaaacaaaaaaaatacaaactcttatttatcttttacatcccacccctaacatagaaccataaaataaatagcttggggcgaaggtagtggtcgtttcaaaaatctcgggtagagatttttagaaaatccgaccacgttaaaggctccacgcttagtggcgcccttttattcgacttttttaggcgagtaaaaaagtcgtggggtttaaggggcaacgcccctttgtattcacggcgtatgagtgaaagcattttatccagtattttttgcttcggaaaaatactggtcgctctttagagcgaaaccctaaaatttaattttaatccgtaagcgtaaccttaatagtcttatttacttccttatcctcttcatctttaaatactccgtatctctttcccagtaactccgcagccttcatggcataactaagctttgttggaatttgaactactttaggtgtttctgtcttttcttttacctgcttaaattccccgggctcaacttctttgtagtcaactttttcctctttgtaagtcactacaacatcttccatctcttcccttctcataaccgatgttaaatattccattacttcctttatatctgccacatcatctgactttgtcttatttaaaaccgagttcatatattcttttataagcgggtttttaaggtttctcgatgcaatactccctgcacattccttgctgtaacctgcctttaatgctgcattatatccgtttaatgatattaaatattcatcggcaaaagccttttgcctttttgtaagttcctttttcttctccattttttcctcctaatataaaaacagagcctaaagctctgtttcctgaattattttatttatttcttctttttttgactttatgtaatttataacataaatcaaaaagtaaaaatataatttataatttatctctttgtcttttatcttaaaagttacaagtgtaaggcgataattgtaggtactaacttttaacttatctgctatttcccttttcaaatctacatttgataattcctttatatcattatccagtaattttattattacctcatctgataacttgtttttttcatttactaaaaattttattatttcttcctttaaagaattatttattatgtctattaaagattcaataactttactatttttaattttttttcttatatcttgatattttttatataaattttcaccattaacgtattttgattccattgttctctttgaaaaataaggataagtttcaaaatgtaaaaaagttttgccttcttctacttccaaatgtatgttaaattctaattttttttcttctttatcttcattgctgccattatcaccctttttttccaatattaaatcacttttaaattttaaatcacgaagtgaaatctgacagaattttttcccattgtaattaccggaactggcataaatatttttattattttgcgcaatagtaggataatatccatttatcatttttagcaaatattcgatataatcttcaattgtatctgaagaaaatatttttttattttctttatccatttcttctgtattctttttactaaataaatcaaaaaaatcttcttctaaaggtgaatcatccatttttttaagctgccaataataaactcttttaaattttttatttgtcagttcataaaatgacttatctgctgtaagataaatataatatttatgctcataatcaccataatttttatctattaaatctacatatctgtctgtctgcttgtttccctctaaggaatagactttgttttcaatgcagtaaacagcatatttacttccatcttttttatttaccgttataaatatatctaccctattttgtttattttttttacctttatcatctattttatcactaaaatcatattcggtttttaccactatcccctctaaatccaattcttcattacccgctatttcttcataatcttcataagcctcttttgcaatcatatcaagaaaacgtatatctttttttatacagtttgcaaaaaatcgactcataacgatctccttactttcgacccccaaaattttaaatatgttagtttctaaatttcttatcatcacacattacctcacttattcatttactataataccatattaaaagtatatttacgtaccaacatactcccaaatttatattctaaatttaacatatttttaaaaacctatctacgattttttctttattatttttgaggtaaggaaatatttcccaattataaatctaatgcttattaccataataaaatttgttgtttattttaaaatactaacttataatttaattaacgataaaatgaggagaaaaaaatgaatactttaataacaaagcaaaacaacgattttataatgcctttttcatatgaaattgttattcctgaaaaagaaaatgattttaactatgaatatagcattcaagatgaaacaaatccaaattttaatgaaaattttaatttaaaagacaaaaccgaaaatgattatattgatagtgaatttttagaatatatagataaccttaccaaaacagattatatactatctgccgcaagtggtcttttttcaggtggaataagtgcctttatttgtaaagaactttctttagataatgctcaaactatgggaaaagaaaaagcaatagatatcgttattaaaatagctaagttcaatggctttaaaggtgataaagatgatatcgccggagcaataaaacatttagaagaaggttatcattttgcttctgacagccatactaatatatacggtggaggcagacaacatcacttaagagattttgcgcaccaccctacaattaccggacttattttctcaattattgagcagttttttttatacagctttggaaccgataaagacggtaatttaatttttaacaaaattacaaacaccaaatatattggtaaaaatatatatgaaaaaatatactatgcaactataaaatggacattccatttaataagcgatatggcaggctcaaagaatacaccgggagaaggtacaggaattccgggaccgattttatcttttctaaaagaagtatcaactctgcctttaatacgagaaataaaaaataattataaagatgatgaaatagaattttcaaattttatatctaaattatttgacggatcatattttgaacataaatctaaagacgatataattaaatttgaccttagaaccgaaatgggaattgcttttcaaatatcaaatcaagccataccggtaattattaatgaatgtattgtaagaggattttattttataaaaagactttatatacaaattaaaataaacaatattaaatcactaaaagatttaaaaaaattagaccctaaaacttttctgcctataaacaacagaaacttaacacatatgattactatttcctctggtgttttctttacggtttcaactgcaacagctgcagtaaaagcagcatataaaggaaaaaacaattttacaagacatttccttttaaatataaattatgttggagtaggacgttttacttttgcacttcttagtgaaggaatatatatattaaaagatctaaaagaaacatacaaaatatataaacaaagacaagatgtacttttaaaagaaacgtttgattttaaaatatatgattacttttcattaaatgaaaaacaaatgcaaatactcttttctctgaaaaaacaaaaagttcaatatgatataaatacaacaaaagatgatgtagaaagaaaaataaaacaaaaatggcttcaactatgggaaaaagatattaatgaaaattataaaaatgaattagttttactaaacaaagacgaaacttataatcaaatatcaaatgaagttggaaaaagtattgatattggctggctttatcttattacaatggaattatctttgtttattccttattatccaataaaatcaaaagaagaaaaatggaataaagtaataaaatataaaagtaattttgaagaagaagaattttgcaaatgtcaaatgattatatcttatgaagattacaaagcaatattaaaagaatataataaaaatataggaaagttagataataaaacaaaaaaaataatcacaggagcaggtataacagcagtactaggaatggcaacaggaggagttatttattacttttcacctcaaattgcagttttaatagctggatcatcttttgctaatttatctggagcagcattaacaaatgcaagtttggcatttatcggtggtggttctcttgccgcaggaggtttaggaatggcaggaggaacgacaatacttacaggaggcggtgtatttataggttcgttaagtggaggaataactacattttctacattaaactcaatttcctcaaaagatttggtattaagtgaatgtgcaaaatttttaacttattgcagtctaatcctagtaaaaaaacaaaataacatcgctatggtaaaaaatatacaaaaaagtattcaagatagtataaatgaattatctaatcaactaaaaattaatgaactaatatataaggatgaaacaataatacaccaaagtaaaaagcaaaaaatgtatataaaatattttgatagatgcaataaaattctattaaatactttgaaagattgatataaagaaagccctaagactattcttaaggctttctatttataaaatacttattttttctttttcatataaattatacttccaccaacaaccacaatgcatacaactaagattactatccacaatgtcatattcgcactatctccagtcccaggagtattcaaatttgaagtattttgagaagaattgttgtttgatgttccttgagatgttcccccactttgattttggttataatctggatcaactgccccgcatacactgcattttccgtcaacatagttgtgagctgttttttctataacactgccctttttaacaacttcattacatacgctgcatacttcatctccgctgtatccttcagcagtgcaagttgcttctttcttgttttctaaagttacattatgtttttcacttatactataagaacagttactgcaagatgttttatgataattttcatctacataagatacactcaaattatgttcttttcctaagatttcacagtcccattgtattggttccataccgttatttgaagcccatgcatccattgcagaaacaagatcattatagctttgcccatttattgtaacaggagtttcaagtttttcattatctgtcttacttaaattttcagaattagctggacttccaaatcccatactgtcatcagaatcataataacaacttcttacagttcctccgttacaatatccaatcaatgtacctgaactatcgtttccattttgagcagcattttccataaaagtaatgttatttgcataacagttacttatggatgtgtaatattcatttacaaaaccaataataccaccccttaatttacgacttccggattctgcagataatgttatatcatatgcaagtacattttttatattagttctattataatattcatcacttgagtaaatactaccacataagcctccaacatttgtactacttccttttgcagaaataacagaattttttatatttatgttagatgcttcacttccggcaaaagctcctgctacggttccggcagctatggaattagaagaattacctacttctacattactattttcaaactttagattttttacacatccgtttaatactacgctaaaaaatccaacagctttattgccgttagtaatactttctatatttatattcatattgcttatggtatgattatctccgtcaaaagtacctctaaataagttctcattattatattcaagattaactccattccagtgtccgataggatcccagttatgtccggataaatcaatatcattttttagggttatagtccatccttcatatgtattaccattatttacttcatacgaaaaaagcccaagttctttggcgcttgaaatttctattgtcttagcactgtcgtctttacttgtataagcagacgcacgaacactatcatcactccagtttaaatcatcagccttaacaaaagaaccatttaagtttactccacccaaaacaataaggcatgaaaccaataccgcaaaaatcttcttaaccaacgcctcttcctccaactaaatttataaaattatttaattaaaatattttgaaattcaatgcattgttattttatcaaaaaacacattattttttcaagatttttataatttcaattaaatattttacattcttcattatataagtttgattagatatttttattgtttaaaaatcgtgtatttcttagtaattatgttttatgttcttacataaatatcataaaaacataaccccatatttcacttctatgtttatctatcttacaaaaaaacattaaaacactaattttatatttaattacaatgttcctattccttacatgaaataattaaaacaatacccccatatttcacttctatgttccactatcttacataaaatcattaaaaaactactactacatttcacaaccatgtcccaccccactacacaaaaccaaataattaggcaggctcgtggtagcttttccgccagtaaaactcgggtagagttttacgtaggcgtcaaaagcgttaaggcacttcgcccagtgatgtctttttatccaaatattttaacaaaacttgattagttctttaagaaaaaaattgaatattccacacctaacaggaaatcacaaactaaataggtttaaggaggcggtagtggtcgtttcaaaaatctcgggtagagatttttagaaaatccgaccacgttataagccttcacggcgactgagtgaaagcgttttttccatatttttgagctttggcaaaaatatggtcgggttgttaagggcaaacagtccttaaaaatagggtttaaggggttccctcctttaatgtcgagttattaagatagaatctcttaagtttccaccacattacataaaaacacgaaaaactatccctacatttcacaacaatgactccctaccttacataaacatcattaaaatactatctcacattaaacgaccatatcccaccccactacataaaaccaaataattagctcggggtggcggtagcttttctgtccgtataaaatgcgggtagcattttgcgagacatcgaaaagcgtttaaggcacttcgcctagaagtgtcctttttgcctctttttttggacaagcaaaaaaagagtggggtgttaggggcaaagccccttaaattaattttaaaaaatttgaaaaaagccgttaattttttttgcgtaaaacattgtaaaatatagttaaagaaaaaatttaaaggagttgggatatggaaggtgtaaattattttccgttggatgtgcatttggaagacaaagtaaatttaattgaagcagaatttggacttacgggttttgccgttttaataaaactctatcaaaagatttacggcggaagtggttattttaccctttgggataatgaagtggaaatgcttttttcttctaaaataaacattgatataaaaaggcttaaaaggatagttgaaaagtgcatcgaaagggatattttctcaaaagatatgtacgataatttttctattcttacatccaaaggaattcaaaagagattttttactattacaaaaaggcgcaaagaaagcgatgttaaatgggattatatcctgcttaacaaaaaagaaataaaagagcttaatctaaaaaaacttatggagcccgataaaaaaattgcatgcaaaaatgacaaaaatgctaacaaaaaggataaaaatgtatgcaacaatgaggaaaatgcatgcaaaaatgaacaaagtaaagtaaaggaaagtaaagtaaataaaagtaaagaaagtaaagtaaaggaagaaaagaaaaaatacggtgattacggcaatgttcttttaacagataatgagtataacgcattaagaatgaatgttaatgattataaaaataaaataaaagaccttgattattatataggaagtactggaagagagtataaaagccattatatgaccatactttcatggtcaaggcgggataaattcaaaaacataaacaaatcatctaaaatcgagattgaggccgatagagaatatgaaacttacagtgatgaattaataaaagaaatgatgatgggagattgataaattatgtttgattttaaaaatgttgaagggctgttatatgcttatccgataataaaaaaaagcattgacatagacagagaaacactaaggatgttagaagattatgaagcagatattcaagccgttaagtatgatggagttaaggtagataaaagtgatataagcaataatactcaaagagaagctcttgatttaataagtgacaaggcttacttaaataaaaaaataaagaaaaactctcttaaagctaagagagttgaaatggctcttgaagtgttaaaggaagcggaaagggatatagttgtaaagaaatattttgacaggtatttggattatgagatttatgatgatttatgtatttcaaagtctacatattaccgaatgaaaaataatgccgttaaaaagattggtgatgttttatactaaggacaaaggggctttgccccttaaaccccttacttaagggctgtctgcccttaacaacccgtatttaaggggtgttaccccttaagatatttaaaaataaaatgttttttatatataaaaaatttaataattttaataatatgcggtgaataatttatgaaagttttgtgttttttatatttactctttttttctacatgaaatattggtacaatattgatgttcatgaaattattatagaaagagagtttatttatgaaggaaagacaaaacaaaaatagtatttttaaaattttctctgttatatttatcatagttgcaatttttgatgcaattatgggattatattcttttatatcaacattatcatcatatacttcacaaggatttgaaatgggtgaagtattaaaatatttatttagtgcattgttccttccatctgtaattgaaccattatgcattataggtggtataggtcttattcttttgggcatatatagaattttagaaaataatattgttgaagttgtttttgatgaagatgaaaataatgaaagcagtgaagaaaatatagtttatgaatcagttgttgaagaagaaaatgttgaagaaactgaaacaagtgaagaaaaagaaaatgacgaagtttcagaagatatggaagaacaagaagaatctacacaagaacaagaagagccaaaagaagatgttgtagaggaagaagaaactgtagatgaagttgtagaagaaaaagaagatgttgtagaaaataatgaagaatcaactgaagacagcgaatctacagatgaagaagctaccgaagaaaaagaagaagaatctaaagaagataatgaataaataaaataacagaggttaaaagaggcatatgtatgcctctttttttattttatatggctatttgcaagggatttacattgcaaaaatcatgaaaaaaatgtataataaaacaattaatggaattgttaaaaaattaagaaaaatgtataaataaaacatggaggaataaacatggctttatatgaaaaaaccgtatatcaattaagagatatgctagataaaaaagaagtcagtgtaaaggaagttcttgatagttatatacaaagaatagaagatactgatgataaattaaatgcttttttgacaaaaacttttgaagttgctagaaaagatgcagaaaaaagcgaagaaagaattttaaagggagaacctttaagttttcttgatggtataccttatgcccttaaagataatatgtgtacaaaagatgtaagaacaacttgttcatctaagttgcttgaaaattttgtacctccttatagtgctactgtatacaaaaaacttcaaaacagcggtgcattacttcttggtaaagttgatatggatgaatttgcaatgggttcatcaaatgaaaactcagcttaccatacagtaaaaaatccttgggatacatcaagagttccggggggatcttctggcgcaagtgctgttagcgtaagtgcatcacaagctgctttttctcttggttcagatacaggagggtcaataagaacgcctgctgctttttgtggggtaacaggtttaaaacctacttatggtagagtttcaagatatggacttgttgcttttgcttcttctcttgatcaaataggaccttttggtaaagatatgaaagatgtagcaagtgtgcttaatgtaattgcgggatatgatgaaaatgattctacaagcatgaaagttgatgttcctgattatacttctttcttaagtgatggtataaaaggtatgaaagttggcgttgattatagccttttagatgaaaacaaaattgataaagatgtttgtgataatataaaaaatgcaattgaaacatttaaagaaatgggtgcagaaatagtggatatttctttcgactgttttgattatgcaatacctgtatattatttaatttcttcttctgaagcatcgtcaaatctttctagatttgacggaataagatacggagttagagaagaaggagagactcttgaagatattataataaattcaagaacaaaaggctttggcgaagaagttaaaaagagaattcttcttggaacatatgctctttctgccggatattatgatatgtattataataaggctttaaaagtaagaagaattattaaagaacaatatgatgaaatgtttaaacaatgtgatatagttcttactcctacaacaacaagcgaagcatttaaaataggtgaaaaaagtactgaccaaacaaagatgtatcttgatgatatatttacggttactgctaatcttgcaggaatacctgctgctagtattccatgtggattttcgaaaaatggtatgccaataggtcttcaaattgcatcaagagcatttggagaaggtaatattataaaagccggatataattatcaacaagtaactgattttcataaaaataaaccaagtttataggaggtaagaaatgaaaaattatactatggtaatagggcttgaaattcattgtgaattaggtacaaaaagtaaaattttctgttcttgcccaacagaatttggtgccgaagaaaatgctcatgtatgtgaaagatgtatggggatgcctggaactcttcccgtacttaataaaaaggttgttgaatatgctgtaaaagcaggtttatctttaaactgtaatattcaaaacttttcaaaattagatagaaaaaattacttttatcctgaccttccaaaagcatatcaaatatctcaatatgatgaaccgatttgtcttggtggatatcttgatataactaaggaaaacggagaaaagaaaagaataaatataacaagaattcatattgaagaagatgccggaaaacttattcatgaagattatcagacattgcttgataataatagatgtggggttcctttaattgaaattgtaacagaacctgatatcagaacggcggaagaagcgttattatttgctgaaacagtaagaaacaatcttttaactgtaggagtttctgactgtaaaatgcaagaaggttctcttcgttttgatgtaaacttatctgttatgccggaaggttcaagtgaatttggtacaagaacagaaatgaaaaatcttaactcttttagatcattaaaaagagctatagaatatgaatataaaagacaagttagagccgttgaaaaaggtgaagaaatagtacaagaaacaagaaaatgggatgatgaaaaagggaaatcattctctatgagaagcaaagaagatgctcatgattatcgttatttccctgaccctgacttagttcctattatcttaacagatgaagaaattgcagaatataaagctcaaatgcctgaacttcctcaagcaaagaaagaaagatttatggaagaatattctttaagtgaatatgatgcaaacttcttagcaggttcaagtgaaataagtaatttctttgaagaagcaataaaagatactaaaaacatcaagtctgttgccaacttcttaatgggagatatttcagcatacttaaatagcaatgaactagaattttctgatattaaatttactccggcaaatcttgctaaacttataaaccttgttgataaaggagatataaacttatctactgctaaaaaagttttaaatgaaatgtttgaaagcggtaaagatgctgaagtaatagttgaagaaaaaggattgaaacaaatgaacgatacaggagaaatcaaagttatcgtagaaaaaattctaaatgataatcctcaagttgttgaagacttgaaaggtggaaagaaaaaagctgcaggttttgtggttggtcaagttatgagacaaacaaaaggaaaagctaatcctggtattgtaaatcaattaattaatgaaattttaggattataaaaaagagagctttgctctctttttttatttgtcttttagcatttctccaacggctccgtaaggatggattagtttaaaatctttatctgttatattatttattttcataacggttgcaccaattatatcaagaactatgcttgtgcaggtagttgacgatgttgcaaccatatctttgtcatccagttcttttaaggaatcaaacattatacaaatatctgaattcttagctaaataagaatccttgttttccgttattgctattatgtaggcaccaagttttttagctattggaatggaatgcataagttcttttgtgttaccgctttttgaaatagggacaaatatatcattttttcttattactccgtattctccgtgaagtccattcattacatttattgcgatggagggaatatatagaaaattatatatatttgctgctctaaaagctgcggtgcttgaagatccacatcctgcaaatattatatttcctttgcaatttgcaattttattacttgctttttcaactatttcaaaatttaaacttttttctaaattgttaactgcatcgacttctctttttaataattcttttattgtatttatattattcataaagataacctccttatgttttattttatcattatttttatttatttaaaaggttttttatgctttatttagtaaaaatattcaaatatattattgaaaaaaagataataatgttttataatataattgtaaatacatcattatgaatttttaaaggagattttaattatgaaagcagttgtatttagaggtccggaagattttggacttgaagaagttgaaacaccgaaatgtccaaaaggaggagttttaataaaagttgaagcagtaggactttgtggttctgatgttagaacttttagttcaggacactttgcggttacacctccttatattttaggacatgaggcagcaggtgttatttgtgaaagtgataatgaaaattatcctgttggtgaaaaaattgttataaatccacttgttggattatgtggtacttgttatttctgtacacatggactaaaaaatcattgtgaaaataaaataacacttggtacaaatttacctggaggatatgcacaatatacagctttacctaaggaatgttgcagcgatgatacaatagttaaaatacctagtgattttaatgttgatttaattcctcttgcagaaacaacatcaagtgtttattctgtacaagaatttgcaagagtaaaagaaggggacgatgttgtaattatgggtgccggtcctcttggaaatctacatagtgctattgcaaaagcaagaggagcaagaaaagtaattatttctgaaccaaatgaatcaagacttgaaatggctcatagatttaaaactacggatgtatttaataatccaaataaagaaactttggaagattgcgtaatgagagaaacagacggtcacggagctgatgttgttatcgttgcatgccctgttggatctgctcaagaacaagcaactcatcttgttaaaccaagaggtactgtagttctatttggaggtcttccaaaagataattgtaaagttcttttcgacagtaacttaattcattataaagaacttaatgtagtaggcggatttgcttatgctccagaagtatttgcaaaagctgttgaattaatcgttaataagaaaattgatgctacacaatttgtaactcatattatgcctttaaaagatattaaagaaggtattaaagcaattaaaacaggggaagcaataaaagtagttttgaaaccttttaatgaataaaattaattaaaaataaaaaagattgttttcggacaatctttttttattacaaaaaaagtaatattgacatataataaaatatgtagtaaaattcgactaataaattaatatccaatttaacaggtttagtgccgggctttatgcaacagtttgatatatctgtgggtttcatggatatattttttatttggaggttatcatcatgaaaaacaatttaacggataagcaacttgcaatgaaggtatctctttggagtatgatagtaaatatatttttatctataatcaaggttgcagttggattctttgggaaatcatctgcccttatttctgacggtatacactctctttctgatgtgtttagtactgttgctgttatgattgggataaatgcctcaagtaaagaatcagacactgaacatagatatgggcacgaaagaatagaatgtgtggttgggatgtatttatcgtcatttttagcagtcataggttttggtataggatatgatggaacaataaaaattattaatcacagtataatagccgttccttcaagcatagctttatatatagcagttttatctgtggttgtaaaagaaatgatgtttagagttacaatgcgagcaggagaaaaaacaggctctactgcacttaaagcagatgcttggcatcataggtctgatgctttatcctcaataggtagttttgttggtattttgggagcaaggttagggtttacaatacttgaccctattgcatgtattttaatttgtttaatgatttttcaagctgcttatgaaataggtaaggattgtgtagataaagtggtagataagtcttgtgatgaagatactgttaaggatatggttgaagttataaaaaatattgatggggtttattcaataaaggatataaaaacgagacttttcggaagtaaaaaatatgttgatattataatttatgtagacggaaagttatcagtatatgacgggcatgcaatagcaatgaacgttcatgaagcaattgaaaaagaatttgagggagtaaagcattgtatggtgcatgttgatcctatttttataaattaaaatttttaacttttgtaattttttaattacaaaagttttttgttcatttatgtataaaaaaagtaaaaaaaaactttatttctcttgatttttcttcttattatggtatacttatgattgctaaaggcaaaaaagcctttttttaatgttgcaaatttgttcttaataatgatgtggactccattatagagagtgatttgcatcgaagttttatatttagtcctgtagatataattcttcaccaagtaatacagcggaggttgtaaataatgagagtaaaagtaacacttgcatgcgaagagtgtaaacaaagaaactataatacaatgaaaaataaagacaatccaaaagaaagattagaacttaaaaagtattgtagattttgcaagaaacatactaatcataaggaaacaaaataaggagtatggttatggcaaaaagtaaaaaaaatgctaaagccacaaagaaaaaagaattttttcttttaagatggataaaaggtatctctgaattttttagaggggttagtgtagaactaaaaaaagttacatggccaactaaagatgaattagtaaagcaaacaattgttgtaattgttatttgcggaatacttacaatatttatttggggtttagatactgttttaggattattaagaggtcttttgtagtaggtaaaaattatgagtgaaaatgttaaacaaattgaaagtgacagcactaaagcactttggtatgtagcgcatacttattcaggatacgaaaacaaggttaaagaaaatattgaagctgcagttattcgtaggaatatgtctgatgttattgaagaagttgtagtgcctatgcataaagttgaagaaacaaaaaacggtgaaagaaaagttgttgaaaagaaagtatttcccggatatgttttggtaaaaatgtacatgactgatgatgcttggtatatcgtaagaaataccagaggtgtgacaggatttgttggaccagcatcaaaaccagtacctttaactgaagaagaacttagaaatcttggcataattgaaaaagaaacagtgacgacagaccttaaggttggagatgaaattgaagttttatccggaccttttgaaaattataccggtattatcgaagaagtaaatatcgataaagcaaaattaaaagttaatatatctatgtttggcagagaaacacctgttgaattggattttgaacaagtaagaaaattttaattgaaagaaaagtaggagaataaaaaatggcaaagaaaattgttggaatgataaaattacaaattcctgctggaaaagctacaccagcaccaccagttggtcctgcacttggtcaacatggtgtaaatatcatggacttttgtaaagcatttaacgcaaaaacagaatcacaagccggtcttataattccggttgtaatcagtgtatatcaagaccgttcatatacatttattacaaaaactccaccagctccagtattaattaaaagagctatcaacctacaaaaaggtagtggagaacctaacaaaaacaaagtaggtaaaattactaaagatcaaattaaagaaattgctgaaatgaaaatgcctgacttaaatgctgctaatatcgatactgctatgagcatgatcgaaggtacagcaagaagtatgggtattactgtagaagaataataactggttatttatctcgtatatatgtgggagaggtaaataagtatttaaattgtaaccacacaggaggatatatattaatgaaaaaaggtaaaaattatcttgcaaaaaaagaaatgattgaacaaggtaaattatatgatgtaaatgaagctgtagcattagttaaaaaaatggcaacagctaaatttgatgaaacaattgaacttcatgttaaacttggtgttgactcaagacatgctgaccaacaagttcgtggtgctattgttcttcctcacggaacaggaaaaacagttagagttttagtatttgctaaaggtgaaaaagctgaagctgctaaagctgctggtgctgattatgttggagcagaagaatatttggacaaaattcaaaaagaaggctggttcgaatttgatgcagttgtagctacacctgatatgatgggtgttgttggtagattaggtagagttcttggacctaaaggtttaatgcctaacccaaaatctggaactgttacatttgatgttgataaagctgtaaatgaaatcaaagcaggtaaagttgaatacagacttgataaatcaaacattattcacgttgctattggtaaagcaagctttggtgaagaacaaatcgaagaaaatttcaatgttttaatcgatgctatcaagaaagcaaaacctgctgcagcaaaaggacaatatttcagaagtgttactttatcaagcacaatgtctcctggagtaaaactttctgttgcaaaattctaattaatatagtataatatattagctaaaaattgaatattaattattcacgataattaaaaggtttaaccttttaatatataccgcagacagcagggggatataatccgtaacaatcctgccgaggttaagaagtggagttatcaaatactctttcttaacttgcggaaagagtattttttatgaataggaggaaatgtcgtgtcatcagaagctattttagaaagcaaaaaagtcattgttgccgaaatagttgaaaaaatgaaaaatgcagaagctttcgttttagtagattataaaggtattaatgttgaacaagatactgcattcagagcaaaagcaagagaattaaacgtagattacaaaatttacaaaaatacattccttagatttgctgcaaaagaatgtggatatgatgaacttgttgacgtattaaaaggaagtacagcagttgctttttgtgacgaagatgttgttgcaccagcaaaagttgttagcgaatttgctaaagacaatgctttagaatgcttaacaattaaaggcggtgtaatcgaaggtagtgtagctaaattagaagaattacaaaaaatcgcaacattaccatcaagagaagcattacttgcaaaaatgcttggaagcttacaagctccaatttcaaactttgcatgtgttatcaatgctatcaaagaaaaaatggaagaagacgaacaagcaagcgcttagttttgtctagctaaagaaataagaaaaataaataggagaaaattaaaatgagtgaaaaatttgataaaattattgaagaagtaaaatctatgtcagttttagaactatctgaattagttagtgctttagaagaagaatttggtgtaagtgctgctgctgcacaagtagtagttgctggtgatgctggtgctgctggtggtgctgcagaacaaacagaatttgatgtaatcttaacagctgctggtgattctaaacttaaagttgttaaagctgttagagaagtaacaggtttaggacttaaagaagctaaagaaatcgttgataacgctccaaaagctatcaaagaaggcgctagcaaagaagaagctgaagaaatcaaagctaaaatcgaagaagttggcggacaaatcgaacttaaatagtttagattataattttaaaagaccacaattatgtggtcttttttgttttttataaattgatgataataaaaaaagacggaattaaatccgtcttatatttttaagttattaacctctaaggtcatcaagaagttctgttttttcttctgttttatcgtctttttgttttacgattttagcaggtgcacctgcgactacaactccttcaggaacatcttctgttacaacacttcctgctgcaacaacactgccgtttcctatttttacaccttctaaaactacaacgtttccgcctatcatacaatcatctccaacgataacaggtgttgctgatggtggttctaaaactcctgccaaaactgctccagcaccaatgtggcttcttttacctactgttgctcttgcaccaagaactgcattcatatcaatcatagattcttcgccgataacagctccgatgtttattgtagcacccatcattataacggcatttttaccaatttgtacaccttctctgatgtttgcacctggttcaattcttgcttcaacttcatttgtatccatcataggaatagctgaatttcttctatcatattccattctatagcttgttattctatctttgttgctgtcaataaagtcaaatacttcttctttttctccaaatacaatataagaaccttgtgtcccgtaatattcaagtccttcaagcatgttttctactaaatcacctttaacataaagtttgataggtgtacttttttgtgcagccttaatgtatttagcgatttcataagggtttgttaagtcaaattgttcttttaatttagcgttatccattattttctccttaaattatatcattcatttggaaatatccatttcctttatcatatatgtatctgcctgctttaactgctcccactgcaaatacttttcttgataatgctgtatgttttacttctattatttcatcttctccggcgaagattacttcatgttctcctacaatagtaccgcctcttacagagtgtattgtaagatcgcttttttctcttttaacatctttaccatatcttgaaaatttgtattcaagttctttatttgaattttcttttattacatctgcaagcatataagctgttccacttggagcatctacttttctgttgtgatgtttttctattatttctgtatcaaaatcttcacaaagaagtttagcaccaagttcaagcattttacttacaacacttatgccataagagaagtttcctgttttaaatacaggtatagttttgcttgcttcatctaaatgtttgtttgtatcttcatcaagacctgttgtagcacatacaagtgcaatattgtttttaacacaaaagtctattaaactgtcaacaagactaaaatgagagaaatctattacaacatctatatcttcttttattttatcaaaggaatcatatataggatattcttcatttccttttatgtttttatcaaatccgcatacgatttgcatatcttcatatccttcgactatgttttttacattttgtcccatggctccgttaaagccgcttatcataacttttatcatatttagcctcttagattaaagaatattctttcaatgttttttctaataaatctcttttacttcctgttagctctgttaaaggaagtctcatatcacctgtattaagtcccattattttcatggcagtttttacagggattggattacattcacagaaaagagcatcacacattggtaagatatcaagttgtttttgaattgccgttttgatatcgccattaaagaatgcatctgttaatgcaacacattctttaggaataatgtttgaacatgttgaaattacaccatctcctccaagagataaaacaggcataatttgatcgtcatttcctgaatataattctacatcttcaggtaaatctttcattattcttgcaacttgagataagtctccacttgcttctttaaatccttttacattttttattttagtaagttcaatagcaagtgatgcagatatatttttacctgttcttgatggaacgttataaacaataataggtacatctactctgtcacttatatattcataacttttataaataccttcatcacttgatttattgtaataaggattattgattaaaacagcgtccgcacctctttttgcggctatttctgtcaattgaagaacatgttctgtattatttgttcccgttcccgcaataaaaggaactctgccgtttattacctcatttgaaactttgaaaatttggtctttttcttcatctgtaacagttggagattctcctgttgttccacaaattacaagaccgttaataccattttctatttgtgagttaataagttcttcaagtacactatagtttactttattattttcatcaaatggagtaactaaagccgtacttacacctttaaaaatagacatattattcattttcctttccaaagaaattttctttaattaagtattcagcgatttgaactgtattagatgcggcgccttttctgatattatcacctacacaccataagttcattccgctttcaacagaaaagtctcttcttattcttccaacgtaaacttcatctccgcctgctgcatcaagtacagtagggtattctggaactgaaatatcatcttttactattacgccaggagcttttcttaataattctcttgcttcttcaaggtcaaaaggtttttcaaattcaaggttgatgctttcactatgacctacaaaaacaggtactcttactgttgttgcagtaacttttacatcgtaatcaccaagaattttatgtgtttcattgaccattttaagttcttcttttgtatatccgttttctgtaaattcatcaatatgaggaagacagttgtatgctatttgaacagggtaaaattcatttttaccgcctttaactccttcttcaagatcttttattccttttagtccagagcctgcaactgcttggtatgtagaataaattactctttttattttatacgcatcatgaagaggttttaaaactaccattgcttggatagttgagcagtttggatttgcaattattcctttgttttttaaagcatcttttggatttacttcaggtacaaccaaaggtacttcatcatccattctccatgctgaagagttatcaattacaacaactccgttttttgctgcgataggtgcatattttaaacttgttcctccgcctgctgaaaataatgcaaagtcgatatctttgtcaaaagaatgttctgttaattcttcaacagtatattcatttccgttaaatttaactttttttcctgctgatcttattgatgccatagggtaaaagttattaacatcaattttgctttcttcaagtacttcaatcattttttgtcctacaacacctgttgcaccaacaacagctacattgtattttcccataaaaatcctcctaaatattttttatagtgttataaaaaataaaagtcgacaatgcgactcataatacgtaaataaatcagtattagtgaatagcactccatcaaagtcgatgacagtcttaatgctcttaacattaagcccgaaaagacacccggtaaaaagtgccaatcctcggcaaattttcctttcatttattttcacttatatttacctatatccaataaattactgataaaatttgcacctctattttaacactatgatatataaattctattgtttttattatagtaataaatgtgttttattgcaagccttttattatagttttgatgtagttttatatttgaaaattaaatttattaaatctttttttgaataatgttttaaatataatttatttgcttttttcataatattttcataattattttttgttacattgatttttttattttaataacaaataaagacaaaaaattttaaataagattgatattatttataaaaaagcgaaaagaggaagaacataaaaatgggaaaaactttggttattacatcgggaaaaggaggagtcggaaagactacatctactgcaaatattggtgtatctttaagtaaactggggaaaaagactgtcgttatagatgctgatataggacttagaaatttagatgtaatattggggcttgaaaacaggattgtttatactattattgatgtaattgaaaacagatgtagattaaaacaggcgcttattaaagataaacgttatgatggattatacttgcttccggcttcgcaaacaaaggataaaacggcaataagaccaactcaaatgagaaaaatttgtaaagaacttgaaaatacttttgattacataatagttgattctcctgcaggaatagagcaaggttttcaaaatgcggttgccggtgcaaaagatgcaatagttgtaaccactcccgaagtttctgcggttagagatgctgatagaataatatcccttcttgatgtaaatggaatagaaaatacaaaattaataattaatagagcaaaagaagatatgatgaaaaaaggtcagatgatggatacaaatgacattttggatattttaggtatagaacttattggaattgttcctgatgaaaaagaaattgttatttcttcaaatagaggagagccggtggcgggaaaagaagatttaataacaggacaagcgtatatggatatagcaagaagaataacaggggaagaaataccaataagaaatattgtaaagaaagaaaatttggtaaaaaggcttgttcatagtcttggattttaggaggagatatgtttgatttttttagggataaaacagatgaaaataaaagtaaagatatagcaaaagaaagacttcaaaacattctaatgaaagaaagaacgaatataacaaatgataaattggaaatggtaaaaaaagaagttctttgcgttgtaaatgaatattttatggtagatgaaagaagaagtaaaacttatcttacaaaaatgaaacttggtaaagaaaaaaaagaagaaaatgttctggtttcgcttatggttattaaaaattaaaagagatgtatttcatctcttttttattttttttctattaattttgtaataaatgttaaaaataaattataataagaaaaaaaggagaaatgtaatgaaagaaatatttacacctatcgttgatattagaagaaaagtttttaaagaagttgcaaaagtagcatatgaaaatttagatattgatttagaaaatttagcaaaaaaaattgtcatggaagaagataacaaaataactgataaaaatagagaaacgttattaatcttggaaagattaagacttgcttttgggcttgatgctacaaccgaaagtaatccatataataaagaaaaagatgttgagaatataaaaaatgaaaagaacgtattaaatcttcctcttgtaaatgttgtaactgatgcttgtatgaagtgtgaagaaaatacagtttttgtaactaataactgtagaggctgttatgctcatccttgcagtgaagtttgtcctgttgatgcaatatattttgaaaatggtaaaagtgttattaataaagataaatgtattagatgtggtaaatgtgtttctgcctgcccttataatgccattgtaaaatatgacagaccttgtaaagcagcttgtggagtaaatgcttatataagtgatgatgaaggtcatgcaaaaatagattatgataaatgtgtttcttgcgggcaatgtattgtttcatgtccttttggtgtagtaagtgataaatcagagatttatcaaacaataaaatcaattcaaaacaataaaaaagttatagcagaaattgctcctgcttttgttggacagtttggaagtgatgcaagtcctgaaaaaataaaagaagcactaattaaactaggattttatgatgttgttgaagtagctcttggtgctgatatgggggctgttgcggaagcaaagcattttattgaaaaagttaaaacaggtaaagaacctttccttgcaacttcatgttgtccttcatgggcagttatggcaaaaagagattatcctgatattgctccttatgtttcacctgctcttacacctatggttgcatgtgcaagaataataaaagaaaagcatccagattcaaagattgtatttattggaccttgtagtgcaaagaaattggaagctaacagaagaagtgtaaagagcgatgtagattatgtattaacatttgaagaagtgtatggaatgtttgaagcaaaaggaataagagtaagtgacttaaaaggtgaacatatggaagatgcaacagcagcaggtagaggttatggatattcaggtggtgtaagcaaagctattataggagcaattaaaaaattcgatcctgaacttgaagtgccaaatgatagagctgacggacttaacggttgtaaaaagattttaactcttgcgaaaatgggtaagagagacggatatttacttgaaggaatgggatgtcctgggggttgtgtcggaggaatgggtactttgatatctcaaacaaaagcagaaaaaggaataaaatcttttgaaaatgaagccaaatccaaagaagcatatgaaaatgaatatattaaagaaatcggagaagaaaatgtcaaagttgaacattaaaataggggatattacaaaagaaacaacggacgcaatagtaaatgctgccaacacctctcttcttggagggggaggtgttgacggtgcaattcatagggctgccggaagaggacttttggaagaatgcaggactttaaacggatgtaaaacaggagaagctaaaattacaaaaggttatcatcttccttcaaaatatgttattcatactgttgggccaatttatagaggaggaaataacaacgaaagcgaacttcttaaaaatgcttatgaaaattcccttaaagttgcagtcgaaaataaaataaaaacaatagcttttccttctataagtactggtgtttattcttatccattaaaagaagcaagcgaaatagcagtaaaaactatattggattttctaaataaggataattcaattgaagaagtaataatagtttgttttgataataatacttatgattattatcaaaaagcattaaagaaattggaggggaaataatgtttagtgctatatgtgtaggtattggagggtttataggtgcttgtttaagatattgttttacaattatttttccttcaaattgggattttcctttaaatactcttcttattaatataattggttcgtttattataggcgtaatatttgcaatgagcgaaaatacaagttatatgagtcctaacagtaaactatttttacaaacaggaatttgtggaggttttacaaccttttctactttttcacttgaaacatttaatttacttgaaaaaggtaattattttttaggaggactatacataataacaagtgttctgttttgtttaataggtgtaatgataggaaaaagcttgatttcacattttacaagttaaggctttattattgtaattattataattttattaaaatcatggcaataaaataaaaattatggtatcatgttgaaatcgaaataaaatttaatggagtagaatatgaaaaaaatattaagtattgttttatcaattatgatgataatggtaccattatcaaatgtttttgcgatagaatctggtaaacaaatggttgctatcggaggagatttaaatgagagccaaagaaagacagtttatgattactttggcgttagtgaaggaagtgtagatgaagttactgtaactcatgatgatgaaaaacaatatcttgaggatgttgacccatcaagaataggttcaaacagtatatcttctatttatattgaaacacaaaatgaaggtgctggtttagatattgaacttcataatataaactggctaacagaagacatatatcaaaatgcacttttaactgttggtattaaagatgcaaaaattgttattgcagcgccatttgaagtttcaggtactgcagcattaacaggagtttataaagcatatgaacaaatgagtggcgaaacagtttcagaagaagcaaaagaagctgctactgaagaacttgttactacaggggaattatctgatgatattggaagtgaagatgcttctcagcttgtaaatgaattaaaattatctatagatgattttaaaaatatggatgatgagcaagtaaaagaagaaataaaaaatattgctgacggaatgaacatttctcttacagatgaacaattagatcaacttcttgatttagttagaagtttagaaaatgttgattttagcggagtaatggatgaacttaaaaatatttcaaatcaatttgctgatcttggtatttgggataaaatagtaaatttctttaaaggattatttaactaaaaatataaaagttaatattatataattatgtaaataaaaaaagcacattatatgtgctttttttatttgtaacttattttatatttcattaatatttttgctacaggaacgccaattacaacggctaccatatcagaaataaattctcctggcattgacgccattggtgcaatccagttgccataaataaaagcttcagccatataatatccgaccattcctattatggtaaaagcaatcatagcaaatactgttttagaaattccaccttttagtaatattttagaaacaacaattccttgaacaagtcttattacgaaagtaaatggtgcccatacagcataaggacttaataaatcgaaaagccccatacctattgctcccgcaagtcctgcttcaacaggcataagaagaaaagttgcaataacaagaactgctcctcctaaatgtataagtccgccgtctgtaaatgaaattgggagtcttatatttatatatgttgcaatatatataaacgctgccattactcccgtaagaacaatatttaatgtttttttgttggtcatattttccctcctgtcagatcacaattattttttattttaatactacattattaaattttcaataataaagtttcatttctattttaaaacgacattatttttatacatctttttatatattatttgtataaaagggaggtaatgttatgaagcttataaaagttgaacgatttgggattatttttattactttatttgtttttttattatcaaatttatattttcttactgagtttgatttctttaaatttatatgtgcaggaaataatagtatgttggagcaaatgaaagttgtatatttttcttatatgttttttatgattatagaaatgatttgtaaaattcagtataatgataatttttttcttgcaaaagcaataagtacatatattcttgtttttagtattccaatgtttttttatacttttaaaaatatgtttggtgtaatgaatactattttttattttattttagttttgatttgtgtaggtataaagcgataaaaagagtttatcctatgatgaatataaaaagtttatagaaaaaataaatgtttttaaaagggataaaattgcagtaggacttaatttaaataattctgataacataaatttaatggagcttatgaaaataattaatttgatttataacaaagatatatcttctttgataatatattcatgttcaaacagattctttcaaataaattatattttaaaccatttttttataataaatagttaaataatatattttgatatttgagtaaaatatattataataatatggaatatactgaatttaaaaatatttctaacataagatacaaaaaaaggagattttatggaagggttaatatataaaatagataaatattctactcaaaacggtcctggttttagaacggttgtttatatgaaaggatcatctttaaatatcccatggggagaacatcctgaagctttaagtaaaaatattgaaatgctttatgataaagaaaaatgtaatatgtgctataaatgtatagaagcatgtaatgaaagaatgcttgcagaagaagaaaacagagtttttgaatgcacaaaatgtggtaaatgtgtagatgcttgtccaatgggagccagaaaacttataggtgaaagagtttctgctgatgaattgattgaaagaataatgccggaaatacagtattataaagcaagcggaggcggagttacttttgccggcggtgaacctatgcttcaagaagaatttttacttgaggttataaaaaaacttaaagaaaaagatattaatgtagcagtttccacaagcggttttatagattataaaataatggaaaaatttattccttatgttgattattttatttatcactttaatttggtaaataaaaaagtacatgaaaaatatacaggacaaagtaatgaaataataattgaaaatttaaagaaagtatgttttatgtctaaagttattatttcaattacgtttattaatgaagtaaattgtaatatgaacgaattaaaacaaattgtcggctttatgtctaaattagaactgtatggaattgtaataaaaggatatagtaataaaaatgaacatatgtatcgtttgcttggaaaagagcagaaatatacattccaccgtccagaaaagaaaacattaaccaatattggtaatttattttcaagactttgtgataatatacaagttgtttcttaaaatatgacaaagtagtataaatttattccatagcttacttgttttttataatgggaaatatatataatatgtgtatgattaatgtataattaaagctaaatttttatatttatacatttgaatattaaaaataaaaagaatattagcagagattatagttatatcattacaggttgtcaaaatgaatttcttttactattctttttattttcttttaaatttaattaggagataggggattatggctaagagtgaaaattataaaatttttgaaaaaagattaaagggaatgaattttaaaagaaaaagacttgtattaattgaacaacttgaaatgtgcgatgaagaaattttgaacgaaaaaagagcaattgaaaaagaattatcattttttgaaagtgcacttgattctttggaagagatggacagaaatattattgaatctaattattttgaaaaaatgagtatggttaaaattgcacaggaaactaactatgatgcaagtgtatgttctaggaaaaaggtaaaagcagttaagcatcttatgtatcttatgacgggaataaaagaagattaaaagaaggcctagccttcttttttttaatcttccatatttaaaagagtatttgcaatattatcaaaaatttcaagagctgctcctgaaccatacccaccattttcaataaatactgtcattgaatatttaggattattatatgggaaatatccgctaaaccaagcgtgaggagtttcttttgtattttctgctgttcccgtttttcctgcaagtccaccataattatcaagagaattattctttgcagttccttttgtacataccattcttagagctttctgcaaggttttcatggtgttatcactaagcttcatatcaaatatcttattttcttttgtttcttttatttctccattttgagatgttacactttccacaatatatgggtaattggtttttcctccatttgctatggctgacattatagtattcatcattagaggtgtcgcttgaacgtttccttgtcccaaggcaatattaaacgtatctaggttgttgtatatattatctggaacaaatgaataataatcgttatattctaatataaagtttttgtttttatttgttttatcatggacacttccaaatccaagttcttttgcataatcaataattttatttgaagtaatgtttccgtttttatcttttatatttaatcttgttgcaagagtataaaaaacttcattgcatgattttgcaaaaccttctaaaactgttaaatctccgtgtccttctccctcgttacaatatcttgttactccgtcaatatttattttaccactacaattaaactcttcatctaaatcaactacattattttcaagtgcaagagctaatgttaaaattttaaatacacttccgggctgatatgaaagtacgtttttatttaaggtttcatcgcttgaatacattgtgattatttcaccggttgtgatgtctgttattactacactggcaccttttaagttgttttttgttaaatattcttttacataagattctgtatatttttgcacatgataatctattgttgtattaatattataaccttcgtttatatggtcgttaactgctaaataattattttggtttattgtttgtcccgttgcatctatttgtgaaagtattttaattgcctcccctccgtttagctgcttatcataatataattgaagaccacttactccatttactgctttgtttgttgtagtgtcatcgtttatttgaatgtttccgataaacgtttttccaatggtaaaatttatgttgttttgaatatttaattttaagttttcaaaagagctgttatcagaaaagtttattccgtttttatcaagtattgcaccacgagggtaataagtttgtataactgtttcgtattgagatgaaagtttatttatgttatctttatcttgaaacatgaaggcttttattacaaaaattgttagcagagtaaataaaataataataaatatggataaaattttaattctttcttgtattattttttgaaacatattataagtattgctataatatggttttttatactatttttaatgatttttagaaaaaaagtgatataatatttaattatacatgacatttaaatgtaataaatgggagtttagatatggaaaaacaaaggaagcttgaattagctactgatttttatcaattaagcgtaagtaacgtttacgaagcaaagggttttaaagacagaaaagccgtttttgatgtctttataagaagaaatccttttgaagggggatattctgtttttgcaggattagaacaagtaatagattatattaataatttaaagtttgatgatgatgacataaaaatgttaaaagaaaatcatcctgaactaactgatagttttttagaatatttaagaaactttaaattcagcggtgaaatatatgcaatggaagaaggagaaatattctttccttcagaacctgttttaagagtaaagacaaatttaattgaagctcagataatagaaactgcaattttagcgataattaatcatcaaagtttaattgcaacaaaagcttcaagaatatgttctgctgccggaacttatgatcctgtacttgattttggacttagaagagcgcatggaacagaagcaggtctttacggtgcaagagcatgtattataggcggttgtgtaggaactagtaatgtagaggctgaatattgctgggatacagtttctaaaggaactatatctcatgcttttattatggcttttgataaagagatagatgcttttagagcatatgcaaaatataatccggacaatttaatacttcttgcggatacttatgatacacttaacagcggtgttaaaaatgcaatacaggtatttacggaagaaagagaagcaggaagattaaaaggtgcttatggtattagacttgacagtggagatttaacatatttatctgtaaaagcaagagaaatgtttgatgaagcaggatttgaaagtgctgttataagtgcatcaaatgatttagatgaatatattatttctgatttaagaaatcaaggtgctaagattggaatgtatggagtagggacaaaaatgattactgcagacggtactagtgctttgggtggagtatataaacttgctgcgatagaaagaaacggaaaattatcaccaaaaataaaagtatctaatgatccaattaagataacaaatccgggatataagaaagttttaagattttatgataatcgtacgaatatagctattgctgatttaataacattaaatgatgagattatagatgaaacaaaacctttaacaatataccatcctgttcatacatggaagaaaagaactttggaaaatttccatgtaaaagaattattaaaacctatttttattgatgggaaacaggtttatgagtctccaaaattatctgaaataagagaaaatcatttggttgctaagagtacattctggccagaatatttaagacttattaatccaagtgaatatcacgtagatatttctgataatttatttgacattaaaaaagacttacttgcatctgtgcaaaaataatttttaaggagtattaaatgaataataaaagaaatgtaggtattatattcggtggtaaatccggagaatatgatgtctctttgttgtctgcatataatgttataaacggaatagacaaagaaaaatatgatttaactttgattggaatatcacttgaaggtaagttttatatttacaaaggtgatgttgaaaaaataaaaaacaatgaatggattgacgataacgaaaatttaatatctgaattttcacttttcgatgatgaaataattaaaaacatagatataattttccctgttcttcatggacaaaacggtgaagacggaagaattcaaggtttatttgaaatgatgaataaaccatatgttggctgtgaagtaatgacttctgcagtttgtatggataaagatattgccaaaagagtatttaaaagcgtagatatacctgttgttgacgatgtattagtatttaatacggatattgaaagtgataaacttttaaatgaaacgatagaaaaatgtgaaaaaaatcttccatatcctatgtttgtaaaacctgtaaacatgggctcaagtgttggtatttcaaaagcaaaggatagacaaggtttaatagatgctcttaaaaaagccgttcagtttgatacaaaaatattggttgaaaaggcaattaatgcaagagagatagaagttgctgttcttggaaattctcatccagaggcttcttatccaggagaaattgtttcatgtaaagaattttacgattatgaagcaaaatatttatcaggtgatgacagcagaatagatatacctgcaaaggttagcgatgatattatagaaaaaataagaacttatgccgttagggcttttaaagctgttggaggaagcggtttatccagagtagattttttccttgataaagataacggaaatctatacttaaatgaagttaatacacttcccggttttacaaatataagcatgtatgcaaaaatgtgggactatatgggagttaaatattctgatttaatagataaacttatcgatttaggttttgaaagatatgaaataaaacataaactaacaataaaagaataataggagaaggtaatgttcggaaagaaaacaagagaaaaagaaattatatcattagtaaaagattcaataaataaatgtatagatgaaaaattgatagaaataagtaaagaagatattccatttataaaagttgaagtgccaagagaagaaaaatttggtgattttagtgttaatactgcaatgcaacttgcaaaaaaggcaagatgtaatcctagacttattgccgaaaatattgtaaaaaatattgatacaaaagattcatatgtaaaagatatttcaatcgcaggtgctggatttattaactttacattagacaataaatggttatatgatgaaatggaaaaagtaatttcattaaaagaaaaatacggtaaaatcgttgaagaaaatccgaaaactgttgatgttgaatatgtaagtgcaaatccaactggtcctcttcatataggaaatgcaagaggtggcgcaataggtgatgttataagtaatatttttacttgggcaggatataaagtaacaaaagaattttatttgaatgatgccggaaatcaaattataaaatttggtcaatctttacaagcaagatatttacaggctttaggacatgatgttgagtttcctgaagatggttataagggtgacgatataattgaacttgccaaaatgcatattgaattatatggaaataaacttgaaaacgttgatgaagaagaaagacaacataaacttgttgaatttgctcttgacaagaatgttaccaatatggttaatgaccttaaaaattatggtataaattatgatgtatttttcagtgaaaaaacacttcataattcaggtgcaataactgatgttattgataaaatgaaagaaatgggaagtgtatatgaaaaagatgatgcagtatggttcaaaggtactgattacggacttgaaaaagatgaagttttaataagacaaaatggggtacctacttattatgctgctgatattgcatatcactatgataaattggtaaaaagaaatattgattatgcaataaacgtatggggcgcagaccatcatggacatgttgcaagacttaaaaaagctatggttgctcttggagtaagtgaagatagattaggagtaattttaatgcagcttgttcatcttgttaaaggtgatgaacaagttagaatgtctaagagaaaaggtaatatttttacattatctgacctggttgatgaagtaggaaaagatgctgcaagatttatttttaactacaataaaccaaatacacatatggatttcgaccttgatcttgctattaaaaaatcaagtgacaatcctgtattttacgttcaatatgcacatgcaagaatttgcagtattataagaaatattgataaagaagtaaaaatagaaaactttgatttacttgataaaaaagaagaattaaacttacttaaagttattgcaaactttagtgatgaaatcataaaagcaagcaaagatttagatccaagtaaaataacaaaatatgctatggatttagcttctgctttccattcattctataatgctcatagagtaattgtagatgatgaaaaactgcttaatgcgagacttgctttagttgttgcaacaagagaagtattaagtaatactttaagtatcttaggtgtaagtgctcctgaaaaaatgtaggagagagaaaatgatagaaaaaagtgttgttgatataatcgctgacatcaaaaaagaagagaattcaaagattgataaagaaaaacctttatatcacaaaaactgcggtgagacgcttattgaagctctctcattgaagtatgaaatagatatagatactaaagcttttaaaatgcttgctccttacgggtttggtcttaatagcggcaaaacctgtggagcttttgcaggcggagttgctgccattggattaatgtttacggaggataaaccatccactaacgataaaatgaaagaaattgtgaaaaaatgggttgaaatatataccaaaagatttggctcaatagactgtgaatatataagaccaagacataaagatcctgtaagaggttgtctaaaggtgcaagaagaagccgggaaactttttgaagaatttataaaagaatatatttaaaaaagcactgcaaagcagtgcttttgttttaccaaatatgaagtaaatgttgtattaataaacttacaaatgctattcctacccaacagcaggctcccataaatataggttttgctcctgatttgataagtttaacgatatgtgtatttagtccaattgctgacatagccattactataaagaatttacttaactcttttattgggtctgttattgtaggagataagttaaatacagttgttattactgcagcaagtacaaagtaaagaataaagaaagggaaaattttctttatgtttactttatttccaccttcatttttttctctttttgttcttacaaaagcaagtaccaaggttatgggtataatagcaagagttcttgttaatttaactattgttgcttcagcaagagtattgcttccatgaattccatcccaagcagatgctgcagccgtaactgaagatgtatcatttatagctgtaccggcaaataaaccaaaaccttcgtttgaaagtccgagcattgaaccaagtgcagggaatattaaagctgcaattacattaaataagaatataacggaaattgcttgtgctatttcttcatcatcagcatctattacaggtgcagttgctgctattgcagaaccaccgcatattgacgagccaacacctacaagtgtagatatttttgatggtatttttaataatttacataatacgtatgaaataataagtgatgttgaaattgtagctatgatgataggtaaagattgtttacctttcattaaaatatcagttaaattcataccaaagccaagtaaaataacggcatattgaagtattttttttgatgtaaatgtaataccgggttgaagagttgatttatctttaataaataatgttataaccattcccgcaataattgcaaatacaggtccaccaacaacaggaacaagtttaccaagataccaagcagggattgatattataagacataaaattaaacctttgatgttttgttttataaattccataatttctcctttattaaatttaatacttatgtattctatcatcttttataaataatttaaaattataaatatttatttatatataaaaatatgttataatgtgtaaaatagatttaaaaggagaactgtaatgttagattttagggtagatacttttttagaagtttgtaaatgcatgaatataacaaaggcttcaaaaaatcttaatattactcaacctgccgtaactcaacatataaaataccttgaaaaaagttatggagtaaagttatttggatataaatcaaaaaaactatatcttacaagagagggagaggtatttttaaactacattacaactctcaaacatgatgatttaaaacttagaaatgaaatatctcatatagataataagagtaaatttattatttttggtgctacgttaactgtaggtgaatatttaatgccggataaattggataaatatttaaagttatatccgaacacaaatatcaagatgattgttggaaatactgataaactacttaaatacttaaatgacggtaaaatagattttgcaattattgaagggtattttcctaaaagtgaatatgaatatattacgatatcgaatgaaaattatgtaggtgtatgcagctgtttaagtgatttaaaagataaagaactttttcttgaagatttgcttgattatagacttataataagagaaaaaggttccggaagcagagaacttattgaaagatacttagagagtaaaagtgttttagtttctgattttaaaaataaaatggaaataaacagcattgatataataaaaaatttcataaaaaaaaatatgggaataacttttttatatgaacttgcagtagaaaaagaattaaaaagtgaagagttttgtaaactcaatataaaagatatgaaaatagatcatgaatttagctttatttggagaaaaaacagccaatatagaaattattataatgatatatttgataaattattaaaaaaagaataaaattattttaagtaatataaggagataaaatatggaaaaatcaagagtagaaatagcagttgaaaaatttaagaatggatataattgttcacaagcggttgtttgtacatattgtgatctgcttggagttgatgaagcaactgcatttgctttggcagaggggtttggaagcggtattgcaagaacacaggaaacttgcggaagtgtttgtggaatggtaatgctggcaggacttttaaacagtgataaaaatctacaaaaacctaaaacaaaaattcaaactttaaaaattggcaatgaactaatggaaaaatttaaagaaatgaatactaccgtaaaatgcaaagaattaaaaaatatcggtaatgatgctccgcctataagaagctgttcaggatgtgttaaagatagcgcaatgatagtagaaaaatatttattaaaagatatgtttgaataaaagaagtcctttatggactttttttatttaaccctacaggtcgtataaagtagtataaatatagtattagaataaaataaaaaggatatcatcttgggattaggacgaaatatagttatatgtagtttcatttatttttgtttgatttatgcttttcattataattttataaaaaaaataaatatttattctttctccgtaaatatatttccttatttttggaaaaaaacaaacggaggtattttttatgaaaatttatggttatgtgagagtatcaaccaaagaacaaaatgttgcaagacagtttgaggctatgaggaagtttccggtggaagataaaaatattgttgttgataaattcagcggaaaagattttaatcgtcctaattacaaaaaactcttaaagaagatggaaaaaggagatgtacttgttgttaaaagcattgataggcttggaagaaattatgatgaaattttagaacagtggagacttttaacaaaagaaagacatatagatattgttgttattgatatgcctttacttgatacaagagaaggacgagatttaacaggtacacttattgccgatattgtacttcagcttttaagttatgttgctcagtccgaaagagaaaatataaaacaaagacaaaaagaagggattatggcagcaaaagcaagaggagtaaagtttggcagacctagaatacatattcccgatgaattttttgagttttatgatttatggcaaaatggtaaaatatcatcaaggaaagcagcaaaacatttaaatgtgtcatatcaaacatttataaggtggacagacagaatggtaaaaggagatttatttgtataaaaaaagcgtctttaaagacgctttttattcttcattattttctttatcttctattatagaaacaacagcatttctgtttaattttacttttactccttcaggatcaagtgcaattaatatatcttcatcataaacttctaaaatagttccataaaggccgctaactgtcattattttattaccttttttaatgctatcaagtagttgttgatgttctttaaatcttttttgttgtggttttattgatgaaaaatatactactacaaacataacaataataataactagcattgcaaaaacattattcattcccatttttttttctccttgaattgatttttaaattattccataatcactttcaaattggtgtttgaactccaaaaatctatcttccataatggcgtttctcatgttttccattaatttcaaagtaaagtataaattgtgatagcttactaacatacttgcaagaatttctttgcatacaactaaatgtcttaaataagctcttgtatagtttctgcaaacatagcagtcacatttgtggtcaagaggtgtaaagtcttctttgtattttgcattttttaaagttactctaccgctgcttgtaagggctgtaccgtttcttgccattcttgtttgtaaaacacagtcgaacatatctataccgcttttaacaccttctaatagagcgtcaggacttcctacacccattaaatatcttggtttatcctttggaagcagcggagttgtataatcaagtaagtcaaacatcatatccataggttcccctacgctaagacctccgattgcatatccaggaaaatcaagatcaataagctgtgttgcagattcttttcttaaatctttaaacattccaccttgtataattccaaaaagtccttgtttttctgtgttcttatgagcctctttacatctttttgcccatctcgtagtcatttcaagagagttttttgtataagttttatctgctccataatgtacgcattcatcaaaagccatcattatatcagagcctaaattattttgaattgccatggatttttcaggtgtaataaaatgtctgcttccatcaatatgacttctgaatgttacaccttcttctgttatatcatttgttttacttaaagaaaaaacttgaaatccaccgctgtctgtaaggattggtctatcccagttcataaacttatgaagaccaccggctttttttactatttcatctcccggtcgtaaatatagatgatatgtgtttcctaaaattatttttgcatctatttcttttagactttccggaagcatcgctttaactgtagcccttgttcctacaggcatgaaaataggagtaggtatttctccgtgaggagttattactttaccaactcttgcaccgcttcttttatcttcttttattagttcatatttaattgcgctcatattttatagttcatccttcttgttatatccgagagaatttaaaatgtttggtttatctctccattcgtcttttactttaacccataattttaaattgactttacaatcaagcatttgttcaatttcttttcttgattcactgccaattttctttagcatattaccgcctttgccaatgataattcttttatgattttctctttcagtatatatgtttgcttcaatatcataaatttccttatcgtctctttttttcatctgcattacttcaacggcagttccatgaggtatttcttctttaagagatcttaatattttttctctaataagttcacttacaacaaatctttcacttctgtctgttaccatgtcttcagggaagtacataggtccataaggtagatatttttctattattgtaactaaagtatcgatattttctcctttaaaagcacttatgggaacaatatcttttataaagtcatatttttcatatagttttatttttacaagaatatcttctttttttattttatcgattttatttattaccaaaactaccggtgttttttcattttttaatttttcaagtaagaattcatcaccttttcctatatttaagtcttcttcaacaaggaaaagaattaaatctacttctttaaaagattcacctgcaacttctaccatataatctgatagtttgcttttaggtttatgaaagcccggtgtatctataaaaaccatttgagatgtatcggtagttcttatacatctaatattatttcttgttgtttgaggtctatttgatattattgatatcttttggcctataagtgtattaagaagtgttgattttcctacgtttgttcttcctataattgatataaatccgcttttataattattgttcattctttcttatccccatattaaatgtattattttaggtatatatagagctatacccattattacagccataaatgctccgattaatacggcacatgctgctgaatcttttgatctttttgcgttttcattcatttcttttgttgcacagttaacagcttcttctattgccgtatttatggcttcaagtattattacaaggaatattataaatccaagtagtaaccattcatagtatgaaaattttaatataattgctcctatgattgcaagaagggcacatgtacaatgtatcttaaagttttgttgtgttttgaaattatattcaattccatgaaatgcatacttaaaactttttattaatctttttatgtttttcatttcttctccttagtctcttgtaagatttagatttttcattacttcttcttcatgaaatctcatttcttttttttcttcgtcattcatgtggtcatatcccaaaagatgtaaaattgaatgaactgtcaagtagcaaatttctctgtcagtactgtgtccaaattctacggcttgttgtttagctttatctatgcataaaacaacatcgcctaagattacaacttcatcttcaaaaccttcttcatccataggaaaagaaagtacatctgtttctttatcaatatttctgtaatatttgttaagctcttttatttcttcaccgtcaactattgatacacttacttgagatggttttgtaaaattttcgtttttaagtgtttcgtttattgcattttctattttttcgtaagtttccttagaaatttcttctttacttctattatcaaaaagtacttctgtttctatcattactttacctcattttcttgatttattttttcttgtcctgggtattgaactctttcatgataaacacctgtaaggactcttaaaaatgctttttttattgtatcaatatccttcatttttagtggagaatcatctaattgatggtctgttatttttttatcaattattttatcaatcatttcttttattttttctttattccctgtatccatactttttaccgcagcttcaactccatctgcaagtaaaacaacggaagtttctattgttgttggtcttggaccttcataagaataagattttaaatcaggttcatatcctctatctttttcttttacatagaaatactgtattaaagtatcaccatgatgagtttttatgaattcaataatttcatcaggcaacttatatttatttgccaaatatacaccgtctcttacatggttttttataatccttacggaaacatttgggtctaaatggtcgtgaggattgttaccgttttgttgattttcgctgaagaaaagcggtttttcactttttcctatatcgtgatagtaagcaccgaccctggctaaaagtccgtttgctcctatatcgttgcaagcttcttgagcgaggttacctacaagaagcgagtggtgataggttcctggtgcgcctgttataagctttcttataagttcgtttgtaggacttgacagttcaagaagtttaaatggtgttaaaatatcaaatatatattcccagaaaagcatcattccaagagagaccattcctgataatagtccgtttatgcctgcatataatatgttataaaacatacttattccaagtgtattttcaagtacgctgtttattaaaactataatcatatttgatatagagacaattaaagcagctttatatattttgcttctttcttgaactctttgcatatatagtattcctacaaaacctgataatagaaggaatattaaagcttctgtattaatatctaaagttactgctaatagaagggttataaatacatttgtatttattgctattcttggacctattaatatgcataaagtcatactcattattgagatgggtattaaatatatattaaataaacttgcaatttgtgataatactatcattaataagaactgacttgctattaaagctaaaagtttattgttgttatatatatgattatgaaatatctttaaataaagagtatatataaccattaaaagtaaaatcatggaggcaagacctattgtggttttatagtcatcaaataaactgattcttatcattgagccttcttgtaaaacgtctatttgattttgggttatagtatcaccttttttaatgattacttcaccgggttcataggtaatatcttcaactgtattttttgcattaagcttagcttgctcggttgcctcttcattaagaaccatatttgcttttaatgcatttttacatacattaatgcatgctgtgcttacatcagcattgaaagatgaatttttaaaataattgtttatttttttataataagtattcatttcatcggatactacttcatcgttataaatgttttctattaaagatattatttcattttttatattatctcttgtatttttatcttgatttattaatgtttgataagtttcttttgttaaatcaattccagttttgctgttgtatacatctattgagcttttagttaaatcatctgattttatatcttcaagttctttaaataatgtgtttatgttttttgttaccgaatctttagttcccggtatatagtcatatacgtttggagtttgttcaacggcttgttcttttaagctgtttgtaagttttgtgttaataatttttcttggcgcaataatatcctccgtagcaacttgtccaacttctacatcgtatctatgcggtatagcactaataaaagataggaaaaaagttaaaataaagaaaattattgctatggataattttacttttttatttgtttttacattttcaaaaaaagctgatatcttagtctctttgtttttttgtttcatattcttcataggcttcaataattctttgtaccaaaggatttcttacgacatctctctttgttaaatgtacaaaatctactccttcgactttgtttaaaattctttctgcgtataaaagacctgatttttttccacttggtaaatcaacttgtgttacatctccggttacgactgcttttgatccttctccaagtcttgtaaggaacatcttcatttgttctcttgttgtattttgagcttcgtcaagaataatgaaagagtcgtttaaagttcttcctctcatatatgcaagaggcgctatttctatattacctctgcttacgtttctttcatatgattcgctgcccattatatcaaataatgcatcatataaaggttttaaataaggatcaattttttcttttaaatctcccggaagaaaaccaagactttctcctgcttcaacagcgggtcttgtcaatattattcttgaaacatcaccgttttttaatgcttttacagcaagagcgactgcaagataagtttttcctgttcctgcaggacctatggaaaatacaatatcatttcttttggttgcatttataaatgcactttgacctattgtttttgtcttaattggcttacctttaaatgtataacatattacttggtcaaaatttccaatgtctttttttttttcatcaattaaatttagaagataattaaaagtatgatcatttattgctgagttatcttgtattctctttatcatacagcttaagagttcttttgcttttgacagatttttttcattatcactgtttatgtttattttattatctcttaatgtaattttaacagagaatttttcttcaatctccattaaatatttgtcgttgcttccaaacagagtaaggttgtcaaattcgtcgcttggaatgtcgatttttgcagtgaatttttccaaattattctccttattgtttttttatttctttttcttctacaatattttcttttaattttatttttgcagtaatactgtagtagttatcttttgatacatcaatatttaaatatatatcaattatgttatctttgtcaatattttgggttttatttaaatattcgatgacatcattttcaatttgttctttatttttcttctttaaattctttatattataccactttgttgttgtttgctctataggtagagggataaaaagtaacttagtttttttcttttcttcttttatttggatatatgatttgtctttgatagtttttttataattaaagtttctatttttaaaagaataagtgacttctttttcatactcgtcatcttcttgtattaaatatgggttgattttgatgttgttataagtgtatttgcttgttataaacacatcgcccatagcatgtatataataagaaataatatcaccgtcttttccctcgtagcttatttctccacttataagtaagtctcccttttttactttatcaccctttttaacttttgttataccattataagcaataatactttctatttttccgctttttgcagccactatatctactgcttttgatttatcaaattgttttattggagaatttttttcggttagttttattatagcttttgttcctttatattctattgttacatctgaaagtgtattatatgtgtttagaagtttttttgatatttgttttttatctataccatatttatagcatccttctttaaatcctatatctgtgagagtagcaataatactgtttgtatcaatatttttactgccttctatttctatatcccatatgaagaaagaaaaagaaaacattacaataaaaattaaaaagacactaaaaataaatatttttcttttttgtagtgtctttagcaatgtattttttccgtattctttttttatttcaattatataatgagcttttttcgctattttttctgcgctctttatttcagataacattattttaaatgttacggttgttttgtctgatgtttttatataccatacggatatattatttatatttaaagctctttatattttaaccttttatccattttatatatttttctttttggatttccatcacaaatatatacttcatttttatttaaaacatatacacttgaccataaagtatccatttttgaatgtttatcatagtcgcacataaaaccatattttccttttaaaagagaacttgcatattcgaatgaacatttcttctgttttaaaagaaaattatacatcgttttatatctttcccttgaatgtatttcatcttcaatgctacaattatattttttcatcttaatagaattaaaatcatttgaacaacataaaaaattatttttttgtcttattatgtttatatcttcacaattacattcaaccaaagccatatctccatatctatcagccattaaaatgttttgagaagatgaaatagttagattttttattttttctattccttcattaacatctctacacttttcaagtaaatttctaactattaccccaccgttcaaaccgggttttattaaagaaggataaacaaaagttaaacctgcagcaaaaccgaactcattaactccatcttcaatttcagacattgcagttgtattaccaacaaaagaataagaattatccaaatgatagtaacaactatcacatacatttttaaattcaacaagataatcactgtttcttccataaataatattttcacaatctttaaaagcaaagcaactacaataattattaaacataaaattatacatacaaaatataaaggaagaaaaataacttaaatctacctttaacccatcacttataccctttaactcgtctaaaaattcagggtattcttttttacaaatcaatgaagattttataccaaaatccatcatttcagcatttataagttttaacttttcatctatatattttctgttatttttaagttttaagccatattttaatccggcattataatgtgatgaaccaaatcttgaatggtacatatttacctcctaatattttattaaaaggcgcctttaaaacagaataaccgaataaaaattttatgtcaataaaataaaaaaagacaactttaaacaaaagctgtctttatatatattaattattaattttaattttaaaggctaaattataaattctttaaatagaactgaaataaatcgttatcctggaataaaagctgaggctcatgcccataatcaggataaataatcatttctttttctgatttaatcttattgtaagtggcaaattgggtgcttggatgacaattttcatctttaaaagccaatgtccagtgaacttttgctgttattttatctgcaaagttttgtatatcaacatagcttagttttctaaacacttcatcttctttttcgtgttttggatcatgtcttctaaagaactcgttaaattcattaaattgagaaatatcaagcaaatcttcttttattgtatgttttatatcgctcatgaaaggatatgtaggagtaattacttttacaccttttactaaagcagaagaagcaattgttaaagcaccaccttgagatttaccgttaatacctattcttgtctcatctacttcttccatactcattaaagtttccacagctttaacaccgtcaagatatatattcctcgcaaaaagtttagttatatcgtcatcttcaagtccacgtatgtactgtccgtaataactaggcccgtttccataccaaggatccgtggaatatcctccctggcctcttacatccattgccaaaacagcaatatcattatatacataaggtaaatattcaaaaggtccttttgtacttgaaccatatccgtgaaaaaatacaatccccggtattttattttttatttctttaggtctaatataaagacaatgaatattggcgccaaatgttccttcaaaaaacaaatcaaactgctctatccccttttccaaaaattctctttttttcaaggcatatcccggcttggtatgttcccttaagtcttttaaagaatcctgccaaaactgatcaaaatcttcaggtcttggactttctcccatatagtctttatatttatcaattgaagataataatggcatagttatatttcctttccttattaattatagacaaatccattttgccaataagaatggtatccatgtaatccattgtgtacctattaccatacaagtgatttgagccgaaccttctggaacagtaatattagcagtttttactaattctgtaaatatatcagaaccaagagaagctatagttaacactacaacacaaataactatcatctctataatgcctctaaataaattacctttgcttgcaacaacacatggtacagcaaaaaatggaagtgttgccaagtcaccaagaggaagaacaacattccaaggtaacacaacagctaatatcaatacaataggaatagcaatcaaaccaagagaaattacaaatgtatgacctgttgcaactgccgaatcaagaccgatataaagttctcttccaggaaatcttttttctagaaatgcctgtgtcatttcagaaataggcatcaaaccttccattaaaagtgacaccattctaggaattagaacaagaacagcggcaacattcataccaacgataaatatttgttgaattgctgcagcaatacttacaccatgtgttgtaaattgtgctaaagcagctaaaaaaccaccaataataaatcccatcattataggttcacctagcaaaccaagtttttctgcaataccttcgcttgtccagtgaatatcttttacaccaggtattttattaagtaaccagtcaataggatatgtatataaaagaatagatactgtttgacaatgtggaattgaaataccttctaaaccaaagacctccgcataatctgcttgcgaataatcagccattataaatgtaatacccattaataccattgcttgtcctattgcaaatacccatgctaaaacattattgacaccacaagcaagtaatatcgctgatgcagaaaacaaaacatgccagtaattccaaatatcaacatccattgtttttgtccaaccaagtaaaatcattaaaatatttgttataataactgctataaacacaaaaggaacagcttctgttgaccacgcaatggcagaacccgtcgcccagccaatatcaatagcagttaatttaaagtttaaattttcaactaaagcagtagcaacaggtgaaattgtcgcagacattaatccgatgattgtatttaaacctaaaaaacctacgccaaaggtcatacctgctcttaaagcttcaccaaatttcgcacccatgattaagccaagtaaagtaaaaataataggcatcattacagatgcacccatatctatgatataggtaaaaatattttgtataatttgcattttaatctctcctttaattattccaaattaaaattatatattgtctaaaaaggaaggccttctttgttttttttgaactatttagacaatatacgtgaaccatataatgcattttatattaaaaagttcattttgtcaatatttattagctatttagctcatatttttcaaataaatatcgttttcttatctataaatcaaaaaaaaatggtatcttttagctcaaaaatatgttatattgtaataaattattgaacaggaagaggtaaaaattttggcaaaaaaaaatatcgaacgattaaattcaatatattcttttgttaaaaacgcaggctatgcatcggtaaatgaacttactgatatgttccaagtttcaatttcaacaataaaaagagatttggaaattttagataaagaaggaaaattaaaaagagtatccggaggagtaacaatcacaagaaatgaattggatactccaacatcaattgtttcttatgcaaacataaataccaataaaaaaataaaaatagccaaaatgattaacgaagtaatagatgacaatgattctatcttttttgatgtagggtcttcttgctatatggcatatcaacatttaacaagaaaaaacacaacaatatttactccatctatacaaattttaacaacggaaaatgaaaatgtagcacatttatattgccttgaaggagaagccgtaagaccttaccttataataagaggattccctcttttagaaaatctaaacagaattgacccaaataaaatagtattttcatgtatggggcttaatgcaaattacaatttaattggaagagttgattatgataactatattttaagaaaacttcttgaaatgaacggagaaaaaatactattactggattcttcaaaaatatgcatgagtaacgaattttgtgtgcccggaattgaaaaaatagacatattaataacagatgacaaaatagatgaaaaacatgtaaaaaatattgaagaaaaaggagtaaaagttcttataggcaaataaaaattttaaataaatataaagaaagaggtgttaaaatgaacaaattaaccgacacattcaaattaaacaatggaatagacattccatgtataggatacggtacattccaaactcctgatggaaaaagcgtggaagatggagtaaaagaagccttaaaaatcggatacagacatattgatacggcttatttttatcaaaatgaaaaaggtgttggaaaggcaataagagaaagcggaataaaaagagaagacattttcgtaaccagcaaattatggaacagcgacagaggatacgaaagtgcaaaagccgcatttgaaaagactatggataatttaggacttgaatatcttgatttatttttaatccactggcctgcaataaaaaaacaatttgataatgctgaagaaataaatgctgaaacatggaaagcatttgaagaaatatatgaaacaggaagagttaaagctatagggcttagcaacttcctacctcatcatatagatgaacttatgaaaactgcaaaaatcaaaccaatggtaaaccaaatagaattccatcctggttttgctcaaattgaaacagcaaaatactgcctagaaaatgatatagtagtagaagcttggtcaccacttggaagaaaagaagttttagaaaacgaaacacttgtagaacttgcaaaaaaatacaataaatcaacagctcaaatttgtataagatgggttcttcaacatgatattcttcctcttccaaaatctgttacaccaagcagaatacttgaaaatagtcaagtttttgattttgaaataagtgaagatgatatgaaaacaatagataatataccttgttgcggaggacaatgcgcaaatcctgatgacgtaaatttttaaataaaaaaaacagacagtttaaactgtctgttttttttaattttcagtatctaaagacttagctgtatcttcatctatattgccgcttactgtaagacctttgtcagtttggtattgttttacagcagctgttgtatttttatcataagtaccgcttgcagttccatccaaatagccaagtcttattaaaatttcttgataagattttattatcgttcctttatgtccttgtttataagttaaagactcactatccaaactctttctcgtttgagcatccattgttcccgtttgagaaagtccttttgctttttgatattcttcacaagcaacttttgtttcggcagtaaagttagcattaggctggttttccaaatatcctaaataatataaaatataattatatttttctatatcagaactggattttcctgatttgtattcaacaacttcactatcaagagatttcatggtatttttatctaacgctccagtttcttttagacctctgctgttttgatattctataacggcatttttcgttgttccatcgaaagtattagttggagaatcagaaagaaaatccaagtaatataaaattaatttataacttaaaacttcttctccactatccccttctttatatgtggttgaataatctttttgagaactaatcaaatcgctgtcatcagttatgtttccagtaagataatcgtctaaatttccggcaaaagcataatatattgtttttgtatttatatcaacagaaaaagaatcttttaaatagttatcactgaaaaacgatgccgtcaataatataaaaaacaaaaatgctactaaatatataaaaaatgattttattctcttcattaaattacctctatatttggacaattttttataaatatgctacaattataacataatgtagacttaaaacaaaatattttattggagaaaaacatgaaaattttaatgaccaataacgatataaacagaagcataaaaagaatatcttacgaaataattgaaagaaatcacggtgttgaagatactgtaatagtaggggtaaaacaaggaggcgtttctcttgcgaaaatgattgctaatcacttaagcagtatggaggatactattgttccggttacttttgcggatataactccatttagagacgatgtaaaaaaagaagatagtaaaattgaagatataggtataaacataaatgataaattggttatattagttgatgatgttttatatacaggtcgctctataagagctgcccttgaatatgtgtttcattttggaagacctaaaaaaatacagcttgcaattttagtagacagaggacatagacaactaccgataagagccgacttcgtaggtaagaacattcctacatcaacatcagaaaatgtaaatgtagtaattgataacgaaaattcatttgtagaaataaactaaggagaaaaaatgagcttttgcagcgatataaaaaataatttaagccatattaatttaaacaatctttacgaaaaagaatgtgaaatatatggatatttacactgtataagtttcctttccctaaaaggaagaggacaattcaatttgatatttgaaaccgaaaacccttctgtcacaagaaggatttttactctgattaaagatgtcttttccataaatcttgaaatagcggcaaaaaaaaataatctaagaaaaggacattatttatataacttgattgtaataaacagcaaagactcaatgaatatattggattattttaatattattgatttcagctcgggatttgaagtaaataatacaataaaacaagatatacttccaactttaagcgaaataagacattatctgcgtgcagtttttctatcatgcggttatgtcagtgacccaaagaaaaagggatatcaaatcgaatttgtatttaataaatttgagtatgcaaaaaactttatagagttactaaaaaccataaatatcaatttaaaatttataaaaagaaaagaagcatatgtagtatatacaaaagactcaaatacaatcacagaattacttggaaatataggagcacataacgccgttttggaaatagaaagcacaaaagtaataaaagaaatgagaaacaacgtaaacagaagattaaactgcgaaacggcaaatatggataaaacaataaatacagcacttaaacaaattaatgcaataaacaaaattaaagaaaaatatggcatggactatctcgatgaaccacttatatcattggcaaaaatgagacttaacaaccctcaagcatctttaaatgaactatctaatatgtttgaccctccgataagccgttcaacaattaataattggttcaaaaagatactaaaaatcgccgatacaatttaacataggaggagaaaaatgaacttatatacagacgaattggaattttttgataaagaacttcttattgaacattttacaaaaaagaaaacaaatcctctttcaaagcaacaagccataaaatacttaaataacttagaagcaagttatagacaacgacttaataaaataaaagaatgtgatttttctaataaagaactaattttaaaacaacttcttgagcaattaagccaatttgaaagagattatgaagtttatggtgaaaatatatataaagaatatgaaacagaaaaatttgaacaaatatggttttattctaaaattctagaagaacttaaagaattaaatgaaaatataaatacaaaagatttatttaacaaatgcaataataaattttttgatttatttgtaaacttctacttttatacaaaagaaaataaaatttatgcagattcaattcttggaacatcttcaataaacatacacgatactacatggaaaaaagaaatcggagtagaaataaaagaatacgaattaaaagaaaatgacgattattatattgaaatctccaaagcagaagcagaagtattggaagacttcttcatgaaagacataaatttaatttattcacaaaacataaaaaaagcacttgattatgcaattttttattttaccgggaagaaaagaaaaatactaaacaaaccttatctttcccacgccttggaaacaatgctcattgcatcgtctttaacaagcgatgaaaatatattgatatcagcacttcttcacggagtggtaaaaaattccgactcaaacataatagaaataaaaaaatattttggaatgaacatagcggaaaaaatacttttcatgacgaatatggaagaaaatttcaacaacgaaaaagactggagcgaaggaaagaaaaatattttatataaactcgacagtgcaaatatagaaataaaaatacttgttttatcaaacgaactttcaaaacttcgtgaaatagataaagattttgaaacatataaagataaggtatggagttatttcaacgagcctgacaaaaataaacataaatggtatcacgaagaggttcttgaaagattatatcctttaagattaagtggtgcttatgacgaatataaagaactaatatacaaaaatttaaccaatatatataattaagaaggacaaagtagtccttctttttatttatttaaattttaaattttattttttttattttattttcattaaatttatcgacgcctcttttatattttatttttggatatccaaatccgataatcatggcaatataatgattatcgggaattcctaacatcgatttttcttttggcattaaatcaagaacatccaaaggataagtcatcataatactgcccaatccccttgaagaacacaataaatcaaaatacacacacgcaatattcacatcctgaatgtagcaaccttctcccacaggcgcatgaggaatacataaattcggagccgaacaaaacaacatatcagggcgtacgattttctcccactctttcaactgttcataagattttttatcatatccatttgcatatattcccttatttgcaagcttttccattttggaataaacaatatcgtgaaaatatttaacttgttctttatcgtcaataaccgtatattcgacaagtcccttattccctccgttaggtgcgttttgtaccgtttttaatatatcatctaaaacccttttatcaacgtctttattcaaatattgtctgtgtgaccttctgttttttatcaaagcatccaaaatttgaggaaggttttcactctcaggaggagtcacacattcttctggagattttccgagaacacttatcgcagatttcggacaaacagccatacaatgctgacatttccaacaaccgtcccacccgaaacaatcgatatctttaataataacgtctttattctcgttaaatttaagaagctgccccggacatacttttatgcatttcccgcatgcaatacacttatctttatcaaaacaaaactttgccaaattatttttcattaccgtttaccaacctttttacaaaatcacttgaaggagaatttataatttcttcttttgttcctatttgctctattctgcctttattcataaccaaaattctgcttgcaagtttaaaggcttctcttacgtcatgagttataaatactatcgtaattcccgtttgctcgtatattcttcttatctcatcctgaagcctgcttcttgttatttcatcgacggcactgaaaggttcatccattaaaagaatatccggacttgctgccaaagctcttgcaatgcttactctttgtgcttcccctcctgaaagttcatcgggatatctgtacatcaattctttatcaagaccgactattttcatccatttattaaccgctttttccgtcttcgttttatcttttcgatttaataatctcggtacgtaagatatattttttaaaacgttcatgttgggaaacaatacactaccctgaaccgcataaccgatatttcttcttaaacttattttgtcgacatctttattatttttaccgtttaccataacgtctcccaaatcgggatcgataagaccattaatcattttgagcatagtactttttccgctcccggaagtaccgattacggttaaaaactcccctttgtatatatccaaattaaaatcgtctaaaacgacattttcgttataacttttctttacacctttaaattctattattttttccatgtgctaatcctccaacaaccctttttcgactaaaaattcatgcgctacggtttttgggtcttttccgttctcttcaacttcataattcatttttgccatttgtttatcactcaaaatattttcaagttttttaaatacgtcgttaagctgtgggtatctatccaaaacgtcgtttcttaccaccatctgacacattgcggaagaaaagaactctttatcgtcctgaagaactaccaaattactgttgctcaattgtccgtcggtagtaaaaacatccattacatctacttttttctcgtctattgctttatatttaagtcctatatccaaatccatcgtatctttaaacttaaaaccatactctgcacaaagtgcatcataaccgtctactctttcaaaaaaatcatattctgcggcaaacgtcaattcatttgatacacttgccaaatcggaataagtttttaaattatatttttcggctatgtcttttcttaccgcaatggcaaaagtatcgttaaacccaaacgaacaagtccatgaaaaatcatatttttcattatattcatcatttaatttttcaaacatatcttcattgtaaaagccatcatgccccagtaccatattccatccggtggaagtatactcaggatacatatcaaattctccactttccattcccggcattatatttgaagtacctcctcccactccctgagtaagatttacattcaagtcagtatcgttttctataacttctttcaacatttcgcttattatatattgttcagtcatcggcttggatgctatgtttatcgttttatttccaaatgaatccagcacaaaagaaaatacaaaaataatcaatacgacaatacatccggcaattacaatcttatttttctttttgttttgtcttttcctcttcaaaatacccttttcgattattcccaaaacaaaatctaccataattgccaaaacagctataagaagactaccgattagagtcatggcagtattatttgtggttattcctctgtaaatgctgacaccgagacctcctgcacctataaaggaagcaataccggcaagagctattgtcatcgtagccatatttctcaatccagaaatgattacgggcattgcaatcggcagttttattttatataatatctgaaaattcgtacttcccattccttttgcggtttctataaacttttcgtctatatttgttattccagtgtatgtatttctaaccataggcaaaagagcatatatgcttaaagcaataaccgcggtaacgtttcctattccggacaggggaatcaaaaatcccaacaatgatatggaaggaatggtatatataaaattcactaaactcaaaacaaatttagagcttttttgatattcgcttataaaaattccgagtattaatccgacaaccaaagcgattatgatagccgttaaagaaatttttatatgatcaagcagcagccccataaaaaattcttttctttcaaaaaacaaacttaacatttttacaacctttctattgctttaacgggacagttttcatagcaatacccgcaccttaaacaatttttacttattatttcaaaatcttcgttttttttaattgacgactgaggacacaatctgaaacatttaccacattgtatgcatttgtcggttataatatatccctcgggttttgtcttttctcctccaagagaatatgtttttcttacaatcggatgtttggataaatcaaaagtgtgaactattcctttttcaatacagaaagcttccaatatatatctgctttgtccaggataaacatcattcatagtcggattattttcgaataccttgtctatccaatatttttgattttccgttttaaatgccttcccttccaacgttatggacatataatctttagtaagtgccgtaaccgaaacattattgttattcataatttctctgtaaaaatctttccctcttgctgtaacaaaatatactttttcattttccacaagcataatgtcaatcactctgcttttgggaacaccgttaaagtcaacgcttgaaaaaacaacatctttaatatttcttaattttgataatatttctctaacatccattttatttctatactccttttttattaaattattgacaacctcaggttttagtttataatattatcaaagatatattttgtaaagtaggcacaattatgtaacttaagtatataaaagtaactataatgattataaaaagattacaaggaggaaagaaatgcgaaaaaatttaccggaatgcccggtcgaaacaacacttttattaataagtaacaaatggaaggtcttgattttaagggatttgatgaacgaaacaaaacgattcggagaattgaaaaaatcaataggagcaatatcgcaaaaagttttgacttcaaacttaagagaaatggaaaatgacggactggtaaacagaacggtatatgctcaggttcccccaaaagttgaatattctcttacacaaacgggaaaaagtttaaaaccagtaattgattcaatgattgtttggggaaatgaatacaagaaacaatataattaaataacttaccctttactaaagaaaaaatatattatatactttataaagattattattaaggagaaaaaaatgaaaataggattagtaggactaccaaatgtaggtaaaagtacattattcaatgcacttacaaaagcaaatgcaggagcagaaaactatcctttttgcacaatagaaccaaatgtaggagttgttaatgttcctgatgaaagaatagataatttaagtaaactttatgacacattaaaaactgtatatgcaacagttgaattcgtggatattgccggacttgtaaaaaatgccggaaaaggcgaaggacttggaaaccaatttttatcaaacattagaaacgtacatgcaatacttcaagtagtaagatgttttgatgacggcaacattactcatgtagacggaagcatcgatcctgtaagagatgcagaaacaataaactatgagctaatcttttctgaccttgagctaattgataaaagaattgcgacagtacaaaaagcagcaaaaagcggaagaaaagaagaaaaattcatgcttgcaactcttgataaagcaaagaagcttttagaagaaggaaaatttattaatttagatgattttgacgaaaatgaaagcgaatatttaaaaagccaagatttacttacaacaaaacctattatgtatgtggcaaacgtaagtgaagatgatttacttgaagataatgattatgtaaaagcattaaaagaatatgtaaaagaagtaaatccaaatatcgaagtaataaaagtttgtgcaaaaatcgaagcagaacttagcgagcttgaagatgatgaaaaaaacatgttccttgaagaacttggaattaaagaatcaggacttgaccaaatcataaaagaaggatataaacttcttgatttaataacattcttaactgcaggtaaacaagaagtaaaaggatggcaaattaaaaaaggtacaaaagcaccgggcgcagcaggaaaaatccactcagattttgaaagaggattcattagagctgaagtaacaaaatatgataaacttatggaagcaggaagcgatgttaaagcaaaagaacttgcttatacaagaatcgaaggaaaagattatgttgttgaagatggtgatgtaatattctttagattcaacgtttaaaaagaattaaaaagaaccttatcggttctttttttatatttatatttgaaataataaaacaaaataatatactatatatatctacataaaaaggagaaaaaatatgaaaacaactttggttggaattaacagcgcatatacgcatacaaatcttgcaatatattatttattcaataactctataccaaaaggtattgatgcagaaataaaacagtacaacataaacatgccaaaagaaaatgttttggatgacttattctctcaaaaaagcgatatttatattttctcctgctatatatggaatatagaatatattttacacattgcctcttccctaaaaaaaattacagatgcaataatcatattcggtggaagtgaagtaagttttaatgcaaaagattattttgacaaatatgatttcatagactatattgtcgccggagaaggagaagaaataactttaaagctgttaagcaaattacaaaaaaacgaagaagtaaacattcaaaacgtatttgataaaagttcaaaagattatacatatataaaacaacatataaattttaatgatgtaatattcccatataaaaatgtggatatgaaagaatttgaaaataagattatttattacgaaagtcaaagaggatgtccttataattgcagttattgcctctcagagcttgacaaaagattgagatttcgcgacttaaaaaaagtaaaagaggaaataatgttttttataaaaaacgacattccccttgttaagtttatcgacagaacttttaatgctgacaataaaagagctaaggaaataattagatttattttagacaatagtaaacacactaaattccattttgaagtatgtgcaaatttacttgatgatgaaataatagaacttttccaaagtgcgccaaacgatatgtttcagttagaggtaggactacaatccataaatgaaaatacaataaaagaaatcaacagaacaacaaacacagaaaaaataggtcaaaacgtaacaaaacttttaaaaaacgacaatgtccatattcaccttgacttaatttcaggacttccttatgaagatattgaatcattcaaaaaaagttttgattatgcgtataatctaaaacctcatatgttgcagcttggatttttaaaggttcttcacggaacaatgatggaaaaatcaaaagataaatatgatttaaaatataataactttacaccttacgaaatattatcaaataaatggatggattatagtgatctttcaaaattgaaagatatagagtttttagttgacaaatactataattcaaataacttttataatactcttgaatattttgtagataaaaccgctaaaactccgtatgatttttttgaaaaattatcagtgtacttttcaaaaaacgggctatataaaagaagtctttcaaaggaagatttatatgaacatttatattatttcttaaaaccttatgatgaaaatcttgctaaaaatttaataagctttgattatttatcttatatgaaaatcagaaaaccaaataaggattttatagaagatattgaaacagtaaataaagaaaaaatatttgaaattattaaaaaagaagaatttaaaaacaaatagaaaataaagaatctgatttaaaagatgcatctgataattcatagattttaaatgttcattttcttcttgtaattttttgttatcatctaataattgatttttagacttaataataattttattgttaagttttttctttttatcaatttcatcagttatatcttctttatctttattgagattaatgatttctttactaatcgattttttattatcttctaaatcagaaacttcattacgaagattatttaattcttgttttagttcatttgctttttcattaaacattaatctttcgtaaggtgtataatctttatttttacctttttgcttttctttaagtttagaatctaattcataaatattattaaattcttcaatacatttttctctcattttgtcttgaataataactaatgattctttagtaaatattgatgttttaccaacttgttttgataaacctgttttacaattttctttaactggaacaccaacaatatgaagatgtggagaatgttcatcaaaatgacaagtcgcattagctacataaaagcttggtactatttcttttaaatcatcaagttgtttttcaaatacattaatcattttatatttttcttctaaatttttattttcccaataagacatatcaccaagttcaattataatctcacaagctaaatcgtgtttatcatcattagatattttattaaagtaattatctatttttctatcatctcttatttgtttattattataaactaaccttgattcttcaaataaatcaaattattcaaaagaatagatttaatcattatagaccttcaagatacttaacttccctttgtgtagataaagattatttttcagaaagtacacttgcaagatttgaaacattatttaaagatataaataaccttttataacagcaaacttattgctgttattttttttgtgcataaaaatattaattctgtgataaaaagcaacatttaatgacataaaaccagactattacacaattcgacaaattttgcgaaaaaattgttgtataatggcaccaataacaatgctgaactatgtaatatatggaaaagaggtatttagaaattaaattgaataaaaaaagaaatgattaagcagtagtatttcttaaataaaataattagattatattactggttaatttttttcataagaggaaaccaattataagaaagttgattgctcatataaaaaatatggcattgttactttgttgtaggagttggtatcccttatgaatgaaaaagaattgttgtattatttaacattaattttaaaacaaatagtaatttatcaaggggaatttgacgctccaaaagtagattattttgatgttaatgattttcaatatggatttaacgccgaatgtatgactcgtttattgagtaatgcattcggcgtttttttgttaattataaaaaagataattgttaggtgtagaagcccaccatctatcaattttgattattaaaaaattgaaattgataggaggaaaataatatggcagaacgcccaaaaagaagaaaatataaggataatccttatactttaaattacatagaaagtaaaaatatttatacagttagttttaaagatgtaaagggaaaattacaggaagtagaaattaataaggaaatatataaagcacttgataggtttgaattagatgatttatctgaaatgaacgaatatgataatcatattgaacattcagaaatatttgaaaacaatcttgaatcaagagcaaaggacaagcaaatattattagaggatatgattattcaaaaagtaacatttgaaaaattaaaaaaagcaataaatgaactaccagagattcaaaagcgaagaataaaaaaatattattttgatgaaaaaacagaacaagaaatagcagatgaagaaaatgctactcatcaatcagttcatataattttagaatgagcattaaaaaatttgaaaaaaatattaaaaaaattagattaagtgtctgcaattttgcgttttagttaggaaacaggtgagagggtaataaatcatcctttcactgtttccttttttgttggaaacaggagttctttgacaattgtatatacattcatcaaatacgttcctactattataagcactttaacaaatacgcttgacgataattgtttggttataaaattagttagcaactaatatgcgaagattaatagtagtattaaagatactcctgtctagccacagcctaaagcaatggggacagcccggagagatcctcggggaggtggaattcctgtgagattaaattagcaatttaatcgtttgatgatttcccaaagactgaggggttcgaggaaaaatatcagttacttaaacaataaaaataaatttagcacgagattttactatctcgtgcttttacatataaggaggaagaatttttaatatgaagaaaagtaaaagttacagagtaactgtaaaattagaatatattataacaatggatcatacgcaaactagtatggaaagagccaaagcagatgttaaagggctagtagataactatttaagaaaaaataacaatttagatattagaaatctgattaataatgaaacaccacatactatttataaagttgagattaataaaaatgaacgaagatagggtaataaaaaaaggagatatttattatgctaatttagatcctattataggaagtgaacaaaacggtacaagaccagtggtggttgttcaaaataacttaggtaataaatatagcccaactgtattaattgctcctttaacaagtaaatcaaaaaagaaaaattatctacctacacatatagaaataaaatcaaatgaaaaaataacacacgattcacttattctattggaacaagtaagagttttagataaaacaagattaatatcatttttatgtagtttgaatgaagaagaaatcaacttagtcaataaatcattaaaggatacttttgatataaaatgataaaaaaaataattgttaataaaacttcttcatttaataaagattttgttgattatcttgaacagttacgaattctaaatcttgtaaaaaataagaaaataattgatgagataacttataaaaagtcaattgtgcaattaaataaatcgcacaattgtaattaattgattattcttataaaatggcattgttcgaacaagaaaggaaatgtttatggatataaaaataattaaaaagaaagatggtagagtagatagaaatactggtttattaataactgaaagattaagggttactgcttatgcaagagttagtactggaaatgaagaacaactaaatagttatgagtctcaaaaaaaatattataaagaaaaaatatcttcaaatgatgaatggcaatatatcgatatgtatgcagatgaagcaatttcaggaactttggattataaaagaaacgattttatgaaaatgattcacgatggaataaatggtaaatttgatatgattattactaaatctatatccagatttgcgagaaatactgtagatactttgaaatatgtgagaaaactaaaagaaaataatgttgcagttttttttgaagaagaaaatattaatacattggaaatgtcaggagaattattattaacaatattaagttctgtagcccaacaagaaagcgaaactatttcatctcacgttaaactagggttgaaaatgaaaaaagaacgtggagaattaataggatttaataattgttacggctatgtatatgattcagataataataaaatgataattaaagaaaatgaagcagatattgttaaaatgatgtttagaatgtatttagatggtaggggtgctgattatattgcaaaacaattaactaaaatgggaataaaaagtccaaaaggaaaagatgtatggggagcaacaacggtaagaggaatattaacaaatgaaaaatacaaaggagatgtacttcaaggaaaaacctttactcaagatccaatatctcacaggagattagttaattatggagaagaagataaatattatatatcaaatcatcacgaagcaattatttcagttgaagattttgataaagttcaagaaattttaaaagcaaagtgtggagcaagagcaacaggaagaagattgggaaatgttggagggaaatatacaatgagttcgagacttcgctgtggattttgtggcgaaacattgggcagaaggacaatgtttgtaaatcaatctaaaaaagttgctgcttggcaatgtattgagtcttcaaaaaatggaaagtataattgtcctgatggaaaaattgtaaaagaagaaataatagaaaatgcttttattgatatttatcagttattggcaaataatagaaataacataattgatagtatttctaacattgttaaaaattcaatgagaaatggaacaactaaagaaaaattagataaattaaaagaagataaaatagaatatgaaaacaaaatttcaaaattggtagatttaatggtagatggtactattgattctgaaatgtttaaaagcaaaaaagcaacattattgaataaaatagagaaaatggataaagaaatagaacaactacaattagtaaaagaagatgatgatgaaattgagagaggaattattaaacttaaagaaatgttaaatagtgataaaatttttaatatagagaagtttgatgaacaaatatttgatgcactaatagattatgtaattattggtggatataatgagaaagatgaaaaagattcttatttaataagatttatatgcaaaaaatcattcaattttacacctaaaaaagatattacaaaagaaatgattaagaaaaataataatttgaacaatacagataattatattacaatactagatgttataagtaatcaaagatttaatatttttgaaaaagataaaaatggaagtagagtaagaaaaacaatagaaaatattcgagttagattggaattagaaaggtaatgtgatataattacactgaaaagacttgtcactaacatacagagaacatagtttgttgtnnnnnnnnnnnnnnngcatagttaatatattataaaaaggcatacgacattaactatacattgcagttatagttagatgacacatgttgagactgtggttgagttggttaaaaaaattgcattataaatgatatattaaattaaaatatataaaaagctttattaaaaagaagaaaaatttaattacatagtttcaaatttgaagaaacttttcaaaacttagtaaagtttgtaaaagatatagatgttccactagatggaattttatatagttgtgatgaagttgtagattattttgtaaattaacatgaatcaggtgaaatatgggaataaatatttttaataaaaatcttaaaatatatagaaatagaaaagaggtaaatgaattaaattattttaaatttatacctgaaaattatattacgttgaaaaaaaatgttataaaaaaaatgggattacctaaaggtacaattctattttgtttgaatacaaattgtaccaatgctttacttctttgttttaaagtgaatgatgaaatctctatgcctttcgatgatgttcaatctgtaattgattctttacatgactcaatggatgataacactggtataatagaggtatcaacagccacaactaagttaagaaaaaaaattatttacactattataaagcataaaaaacaagtttataatgatcttcagtttggagttgaatatacattaaatttaaatattaaagtgaatgatgaagtgtggttaattaatgggtctttttgtgaagaaggaattaccggatatagggataatataatttatacaactgtaatggagaatattaacttgaacaatccgtttgatgaatggatgtatgatccatatgataaaaactatattcaaggttatctaatgaatatatcagagaaaccagaatatgatttaatgtttcctgaacatcctttatccgaattgagaggatatattaaatatattatagaaaataattaaatttgaaattatttttttatttttatacctattcttttaggtttttagtgttttaactttctaacgataaaaacgtgaaatgaaaattttagtttttaaaatatataaaagcaaaaggaagttctaaacatattatataaaaagaggtttttatgagcgaaaatagaataagtgatggaagtgctgcttttcttgtttatgataaagcaattgatggtaatgatacttttactaaatggcttaatgataatggattttctaaatgggataaacatgggtattatagtggatgttcttgggtatatattaatttaaacaatagattatatgcacctggtatgccaggcattgctattacaagtgttttaggaaatcatgctattactatttcagaatttaaaactatatataaaatttatgaaaaatatgatggaaaggatgtatttgtatttaacacaaagaaatttgattatgattaaaatataatcgtatataataaattgatttatatttcaacacaaaagaatgtaaaaataaaaaggaacaaaaaatgtactatataacaggagatagacacggaaatttagaagacttaatttattttacttttgaacatatgacgaatatagatgatgtaatgataatattaggggatagcggtattaattattatcaagatgaaagaagttatatgataaaaaatatgttattacaggcaaatataacatttttctgtattcacggtaaccatgaagaaagagcaagtaatattaatagttacaaagagaagatatggaaaaatggtattgtatattatgaagaagattaccctaatttattatttgcaaaagatggagaaatctatgattttgatggtaagaaagtgattgttattggcggtgcatatagtgttgataaagattatagactaaagaacggtttaaactggtttaaatcagaacaaccaagtgaaaaaataaaagaacatgtggaaaataatctaaataaagcaaattgggaagttgattatgttttatctcatacatcctctttaaaatatgagcctgtagagtattttcttccatttattaatcaaaaaagtgttgataaatctactgaaaaatggcttaatgaaatagaaaataaactaaaatataaaagatggtatttaggacattatcactgtgaaaaaatagttgataaaattaaaataatgtataaaagtatagatgagtttaaataaaaaagttatataccaaaacaacccaatatataagcatgatatcaaataataagccgcaaaatatagaaattactcttgataaaaaagttaggcaaatgtagaagaacttgttaaaagaataaataaaattcatattttaaatattcaaatacatagataaattgtaagaaatgataataaaaataggtattcaattaaaagtatgaaaattaaataatggcaaactaaggactttcaatatatatttatgttagatttgaaatgttatgctaaagattattaatcatacaatatttacactctatatagcttgcgaacattaaatataaaaagaaaaattctaattaaagtacaatttttgtgaaaattaaaaaataatgttagactttgaagtcgatttgtttttgtaaatagatgaaaaaacacggcgcatagaatttgttgctgccatgtttttataatgttttatattagtttgaaatcacaagttctaatgcattacatggggtagtaaagacaccaatggtatcaccatttgaatcgaagaattcaacctcataataagtgccatcatattctaaaacaattgcacctttagttccaacgggaagaccattaaattctttaataagttttactacatctaactctttcataatctatctttaaaatcctttaatataggtattgttatttttataataagagcattatatattttactaaaactaattataatatatcttatcaaataagttaagtacaaaagtaataatataaattaatgtttattggtgcgttaatattattttcttatttatttaaccataaaataggagtatagttttaagatataaagacatatgcattataaactatattgattaaccttatttataaatattacttgataataaaataataggttatgtgttacttaatatttctaaaaaaacctaaaataattttaagttgttacttgatatttttatttagtaacaacttatttttatgttattataaaatttatagaatgaaaatgattaaggtttaaaataattttatttgggagtaagaaatgaaatttatgcatttgtcggatcttcatttagggaaaagagtaaacggttattcaatgattgaagatcaaaaatatattataaataacatattagaaattatggataatgaaaatattgaaagtgtaataattgcaggagatgtatatgataaaagtgtacctcctgtagatgcggttgagttatttaatgattttcttgaagaacttgaaaatagaaatctttatgtatttgtaataagcgggaatcacgattcaccggagcgtattgcctttggtaattcatttatgcgtaaaagtaaaatatttttttcccctgtatataacggagaaattaatgaaatagaattaaatgatgaatacgggaaaataaatatatggatgttaccttttataaaaccgttaaatgttcgtaaggtttatgaagataaggtaataaatacatataatgatgctgtaaaaacagtaatagataatcttaaaatagatacaaacgaaagaaatataatgattacacatcaatttgtaacgggagcagaaagaacagattcagaagagatatccgtaggtggaagcgataatatagatgtatcgaattttgataagtttgattatacagctttagggcatatacaccgtcctcaaaattgtaaatcagaaagagttagatattctggaacaccacttaaatattcattttcggaagctaaggataaaaaaagtgcaacgattatagatattaaggaaaagaataatataagcattaaaaccgttccttttaaacctttaagggatatggtagaaataaagggaaaatataatgatattatgcgacttgatttttataaagatacatcttacagggaagattatatgcatattattcttacagatgaagaggatatacctgatgttataacaaaacttagagcagtttatcataatataatgaaagttgactatgataacattagaacgagatcttcaaatcaaattaaagaaattgaaaatatagaaagtttttctccttttgaattattttcagatttttataagcagcagaataacaaaagcatgaatgaagaacaaaataattatattaaaaatacgattgaagaaatatgggggaatgattaatgagaccaactaaacttataatgtcagcttttggtccatattcaaataaagttgaaattgattttgataaacttggggaaaacggactatatttaataactggtgataccggtgcaggcaaaacaactatttttgatgcaataacatatgcattatatggaagagccagcggagaaaacagagatgcaagcatgtttcgttcaaaatatgcacttgaaagcactccaacaagtgttgaactaaattttacatactccggtaaagaatattatataaaaagaaatcccgaatatgttagacctaaaagcagaggagatgggtttacaactcaaaaggcaagtgtagaactatatttgccaaacggtaaaacaatagataaacccaaagaagtaaatgatgctgttatagatattttaggtgttgactatcatcaatttactcaaattgttatgatagcacaaggtgacttcttaaaattattaaattcttctaccgatgaaagaaaacagatttttcaaaaattatttaagacacaaaaatataatttacttcaagaaaaaataaaagaggattttttagaaataaataaaaaatataacagcttgaaaagtactcttatacagtatattgatggaataaaatgtgaagaggatgagaatctttatttaacaatagaaaagataaaaaatgaggaaactccttttatagatgttattccattaatagaatatagcataaatgacagtactaaagaagaaaaacaatgtcaaattgaaataaataagttagatgatgaaatagaagaaattacaaaaattcttacaaaagcaaaaacacttataaatgctaaggaaagcattaaaaaatcagaacaagaacttattaaaaaagaagaagaaaaatataatttaagtttaaaagttgaagaagcaaagaaagaatacgataagagagatgatattctaaacgaaattactcaaattgaaatcaagcttgatgattatgatgaacttgaaaaaaatataaatgaagaagaaaatataaaaaatgaaataaagataaatcaaaatttatttaatgaaaaatctttaaataaagaaaagttggaagaagaaataaagaatatagaagaagaaataaaaaatatagaggaaataataaaaaataaaagtaattatattgagaagaagtccaagttagaaaaagaaaaagaagatattgatactatcataagttataaagaaaactttgataaaactaaagaagcatatgaaaacttgattaatgattacaaaataaaatccgaaaaagcacaagctttaaaggaaaagtacgataagggaaacagagcatacctcgatgagcaagcaggtattttagctaagaacttaatagaaaatgagccttgtcctgtatgtggttcaacttctcatccaaatcctgcaaaacaagagtttaatgctcctacaaaagaagaacttgaaaaactaaaaagtgaatttgaaaaagcacaagaagaagaaagaaaagccagcgaaaaagcaggagaggtaaaaggttctttaagggaaattgaagaaagattaaataagctttcaaatgacattttaaatggtaagtctttagaagaaaagaaagaagatacagtaaatctattaaatgaagtattagataaaataagtgatatagaagataaagaaacaacaaaagaagaacttaatcagtcacttcaaaaaaacaaagataacttaacgaagttaaaagatgaaattcaaaacattataaattcaaaacttaccgatgaaactatgctaaaaaatatttctcaaagaatagataacttaaaaggtaatcttaaatatgagaataaaaatcatgctttaaaaacaaaaaaaagtttagaacaaactaaaaaatctattgaagaaaattataaagaaacaaatgaagcatttgaagattgtaaaagaagtattgatgagataaaaataaaaatagatactaataaagaaattataaaaaatagtgaagatgttgatataacaaaagaagaagaaaaacaaacatatttaaaaacagaaaaacaaaatttacaaaataagcaaaaaaatattaacctaacaaaagaaattaattcttcatatttagaaaaaatacaatcaaagcttaaagaacaagaaaaggttgaagaaaaatataaatggttaaacgcattaagcagtactgcaaacggaactttaacaggtaaagaaaagataatgcttgaaacatatatacaaatggcatattttgacagaataattaacagggcaaatattagattaatcagtatgacttcgggacagtatgaattaataagaaaaacttctgctgataataaaagaaagcaaagcggattggaacttgatgtaatagaccattataacggctcaaaaagagatgtaaaatcattatcaggaggggaatcttttaaggcgtcgttatgtttggcacttggattatgtgatgaaatacagtcctctgcaggaggaataaaacttgatacaatgtttgttgatgagggtttcggttctcttgatgaagaatctttatctcaggctataagaacactttcatcattatgtgaaggtaacaggcttgtagggataatttctcatgtaagcgaactaagagaaaaaattgataagcagattatagtaaaaaaagaaaaaacgggtgggagcaaggtaatagtcgaagtataataaaaaaacttcttaaaatttaatattttaggaagttttttattttttgtttttatttgtaagtatatataattgagtttgatattttgttgtgataaaattttttataacaggtgataagttatcataaggagaaataatatggataataaaatcggtttaacatggataaatttttatatggaatttgcttcagttttattaaattataaaaataatagaaatgttcttatagataagttgaaaaaaatatatagagagaatgaacaatatattaaatttcctacatttgaaaaaaataaagacattatagatatcgatcctttttcagtttttggtctttttaataagggaataaaagatagtaacaggaaactaattttagaaggtatatcaaaagaatttggagttaaaagtaatattcctttagactttgatggagttccatatatgaataatcgtaaagcatctttcttctcttttattgaaaagagaggagcaggagatatagacgggctttggaatatgtttgaagcgggaattaattacgcagataataaaaatgataaaacgagaaatgattttattattgcttataataatgtaataaagcaatatggtgtatattggaatattacaatgggattattttggattcgtcccaatacatatataagtttagatttagtgaatagagaatacattttatcatgtgatattattgataaaaaagtacattacataacagatggattaagaaagatgccaatgggacaagattatctatatttgattgataatatttctgctaatttaaaaagtggaaaatatcaatttaaaaactttgttgaattatcttcttttgcatggactgattacaataacaaaaaaaataatatagataaagaaattaattctacacaaaatattgaagaatataatccaaacattacaaaagaacaatggaaaaaatttattataaacgttgaaaaaccactaaattcaacatcaataaaaatgttaaaagcaataatggaattaggtggtgaggcttattgtaatgaattaatagaaaaatatggagggaatttggattattatgtaagatctaccctggggcttgggaagagagcaaaaaaatattttaacttaggaaattacatagagcatggtaaagaaagaatatatgtaattccttttgtaggtaaaaaaacaaatgaaaataatgctgataattttgtttactccataaggaaagaattaagagaagcgttaaatgaaatagatttatcagatatttcaccattttatgaaaatgaaaatttacttaatgggacaacgaaagaagaaaaaaatatgcaggtaacagatattagaaaaaatactattttatatggacctcctggtacagggaaaacatataatacagtattatatgcagttgcaataatagaaaataaaaaattagctgatataaaaagtgaaaaatatgaagaggtattaaaaagatataatcagtataaatcagatggattaattgaatttacaacatttcatcaatcttatggatatgaagaatttatagaggggataaaaccgattattgataataatgaagatgaaaacagtgatgtaaattataaaattgaaccgggtgtttttaaggctttttgtgataaagcagaaacagcttctttaagtaattcaaattataatttggaattaaataattcacctgagatatggaaagtttccttagagggtacaggtgaaaacaggacaagaagtgaatgtatggaaaatggtcacataagaattggatatgatttttatggagaaaatatagaagatgaaacaaaatttgaatttgggggtaaaaatgttttaaatgcgtttatttccaaaatgaaagtaggagatattgttttatcttgctatagctctactacaattgatgctattggtattgtaagtggtgaatatgaatggcatgatgaatatgaaaagtataagcgtttaagaaaagtaaaatggatagtaaaaggaataaaagaaaatattgttgatataaataatggctgttcattgacattatcttctgtatataggttaaacatttcattgtcagatgtaataaatattatttcaaaatattcaggtgtgttattacattctaaaaaaagaaaaagtaactttgtttttataattgatgaaataaatagaggaaatatttcaagcatatttggggaacttattactcttatagaagaaagtaaaagaataggtgcaaaagaagaattaaaattaagactaccttattcaaaaaaactttttggagttttagataatatttacatacttggaacaatgaatactgccgaccgttctattgctcttattgatacagcccttagacgtcgttttgattttgttgaagttttaccaaatgaagaaattttaaatgatgtatatgtagaaggtgtttctattaaagatatgcttaaaaaaataaatatgagaatagcagcattatatgacagagaacatatgattggtcattcgtactttatttctcttataaataatcctgatttgaatactttatcaatgatatttaaaaagaatattattccgttattacaagagtatttttatgaagattatgaaaagattggtttaattcttggggataacaataaaaacgatgaagaaaaatttattgttaagaaatattatgattataatatgttgtttggaaataatgtagatattgatatagatataccttatatatatgaaattaatgaagaagcatttgaaaatattaatgcttataagatgatataagttgaaagaagtaaaatttatatgaaaaagatatatcaaattaaagaatatggttcgttctcaaaaggtagagaggttaaaggatatatttctctacctgatgatacttttgatgatttagaaaattttatactatcaaattcttttaaatatactcaaacccttgatattatgaaactttcggttcaaagaggtgtaggaaaaattattacagcacaaaactatgtaggcatgattacaatgaacgacggaactgttatagagatacttcctaaaatttattcaaaagaagaagagaatgaacaaaagacaaaaaagctttttatagatatgcttaaatcatttaaagaatttccatataaaaactttcaaatgtctaatatggatatttcaaaaatgagcatatttgaaatttttataagaatgtttattgatgaagttttttacattgtaaaaagaggaataaaaagtgattaccaaagagtatctgaaaataaaccgtttttaaagggtaaaatagatttctcaaaacaaattaaatataatttaatacataaagaaagattttttgttcgttataatgactataatactaattgtattgaaaacagaattataaaagaaactttattatatttatataaatttacatcttcatcaaaaaacaaaaaagataataaaagaaataaaaaaaatggaaaatcaaaatgttaatgaaatagaaaaagttttaatcaaaaacaaagaaaacatagataaaaatattaacgaactaaaatatacaaaaacattaatcgaaaaaagaattaatcaaatacaaatttattatgaacttataaataacccttatcaaaaagcatataaaatagaaaatataaaatatatcgtgaactttgatataaataacaaaaatattctttcaaaatatataagctctcccgaaaactttgtattttataaagaaaagaacgaagaaatgaaatatggttttatattaaataatacaaacaaagaagataaaattctttggcagaaaaaagaagataaaaacaagaaatatgtaaaattcattttaaaacaagattattataacctaaatacaaatttagattttcatattaaaaacttgactgacatgggctataaaacaggtaaaatgatagcaaaatatttaatgacggatttcgagggtaaaaagtacgattactatgaaacatatatggaaataaaataaaaaaaggacctaacagtccttttttacattataccaagatccataagaacatcttcggcatttgttgcagctttaactttaccataaactttttctatatttccttgttcatcaataatataagtagttcttactacacccatgctttttttaccgtacatattcttttctttccacacatcataagactgaattgctttaagttcagggtctgaaagaagaataaaaggtaaatcatgtttatttataaaattagaatgagacttttcactgtctttgcttattccgattacaacaatgtcgttatctttgtatttatcatagttgtctctaaatccacaggcttgttttgtacatccaggagtattatcccttggatagaaataaagaacaactttctttcctaaaaaatcagataaacttacttcttttccgtctttatcgttaagtgtaaaatcaggtgcttttataccttgttctaacataatattccctccttaaattttgaagaaaacaaaattattttcatttgaatattcttcactgaaactatatccattataacaaaattcttttaatttatcactattatttatctttttatcaactatataccttaccatttcccctcttagcattttagcttcagttgcaatagtcctaattttccctttatgaaaactcttaaaatcaactgtgataaatttatcttcatcttttaaatatggcgtaataacttttgaatattcctttgaggcaagattgattacttcttcattatccttatataattccttataaatactgtctgcccagaatttatataaatttttaccgtctatatcaagtttacactgcatttcaagtctatagggacaaataccgtcataaggttttaatatgccgtataaaccgcttattaccctaatggtagagtttacaaactcataatcttcttccttaaattcttctgcttttatatgtgtatattgaagaccgttataagataatattgcaggtatttcatgcttaaaatcaaagaaatcattatagtaaacaaaagtttccattgctatttttggatttactttcataatactttctatttccataggcgaaaacttctttattatttttgcaagctgttttgccttattaaaaaatacaggagttgtaatttcctttttttcatcatatgcaattttcattttctttgcaggtgaaattattactttcaatgttaaacctcttttataaaaaatttacgaatgctcccgcaagaaccacagttataagtcccgatacggctacggaaagtccgctcatagcaccttcgacttctcccatttcaagagccttggctgttcctaccgcatgagcagctgttcctattgcaagccctttagatatagggtgcttaatcttaaatatttttaggatatattctcccattaaattcccaagtattccggttattattattacggcaaccgttattgaagcaattcctccgaattgttcacttacagtcattcctattgccgtagtaattgactttggaagaagagtaacatattgctcatgagtcaaagcaaataagtatgaaaacaataaaatacttccaagacttgagagtactcctgcagttatccctattataattgcttcaaaattgtgtttaagtgtttcaaattcttcgtataaaggtattgcaagacatattgtcgcaggggttaggaagtagcttatatattttgcgccctcataataaacatcatagtcaattttaaaaacacttaatataatacttacaaaaataatgccaataagtataggattaaaaacatttaactttgttttttttcttattatatcccctataaaatacccaagtattgttatcaaaactgcaaaataaagagaatttttaattatttccattattcacattctctttatctttatttattacaaattgtgaaacatgccccgttacaaccataacaataattgtagttacaaaaacgattattgtcataggaaacaaaaattcctttaaaaccgcaaataacgtaactatttctactcctataggaacgaacattataggcattgtatccagtaaaaaaccgccaacgtcttttatataacttaatttaagtatatttgattttagaagtatcagcattattacaagaccgtatatactgcttggaatcggaagcggtattatataatttaacagctcacttacaaaagttattaaacaaatgattaaaaattgataaaaatatttcatattatgcctttctaaaatgtattttgaaaattaattatatattaaatatgaaaatttttaaagttttttacattccaaaacaaaacttttaatatttttttgctgtctttaatcttatataatttgcctttctattatataaaatttaacttaattattgttaaaaagcataaagtatttactttaattttacaaatattttaaataaaaaagacacataacgtgtctttaaaaacctaaatagaacatatagaaagctataataagcattaaaattgaaagcattacttttactataaactgtacttttgcatatttttcccttttgttcaaattttttgtaaatccaataccggtacctacaagaactgttaatataccgtgtcccacagaataacaaaataacattattattcccattaataaacttccctttgatgcaacaaaacttaaaataacaaccaaagcgggagttgagcagggagaagaaaaaatacctgcaagtataccgcatataaatgctcctatatatcccgttttaccgttttttgcaaccaagtttgttgagggtataaaattataaagttccaatgtttggagagccattaaaaccattattattccaagaaatatataaaaccatttacctgaaagagaaagtatgtttcctattagtgctgaaactacgccaaaaagcgtaaatgtaagtgctgttccaagagcaaatataacgcttaataaaaatagatttttcgtttcttttttgctgtttaaccctacataacctactatcaaaggtattgaggataaggaacatggagtaaatgaaaccaatattcctgccaaaaaagcaaataatggagcaaaagcagagcttgaagctattatgtttgataaactttctattagttgattcatattattctactcccaaatctttaaatattgctctgaattcttcttcgcttaatattccctctcttgcggtaaataaatgttcatttgtatcttttgaagtatattttattaaatctactcccggagcctgggttggagaataaggtttgccgtttttatcaaagaagaaaatagtcggtgtaactcttattggaaaatcttctataccgctgacattagcatctatattaattgttttaatgataatttttccttgatactcttttgcaagattatgtattgtaggttccatttctctgcatggaggacatgttgaacttgaaaaatttagaatgattggaagattttgttttttaagttcatccatattaagacttgttatatttatgttatcatctacctttttgctttcttcaatatttttaaatatatatattccaccgattattaaaacaattaaaatcgggactattactcttaagacttttttattcatattccatctcctttcatttagtttatatagtttatcatataatttgtattttgttaaccataacaaaaaacttttttagaattattttaatttacattatttcctctacataaattatatgcttaaaataataaaaaacctgcaaatataaatatttacaggtttctattttataaattatacatatgatttaaaggtccacttccccttccaagatctaaccctgcctttagggctcctgttatataatcctttgcatttttaatgctttcttctttagaatagcccattgcaagattacaagcaattgcagaagaaagagtacagcctgttccgtgagtattattagtatctactctatctcccttaaaccagaaaatttctccattatcatataaaagatcatttgcgtttttatcataatgaccgccttttataagaattgcactgtcaatgtttttagatatttcttttgctgctttaatcatatcttcatcactttttatactcatacccgataaaacttcagcttcgggaatattaggagtgattattgttccaagtggaagaagtctatttattaaagtatcttttgcttcatcacttataagcttacttccgcttgttgcaaccattacaggatcaacaacaatattttctgctttatactcaattagtttatctgctatggcattgattatatcgctgtttgaaaccataccaatttttaccgcatcaggtcttatatcagtaaaaatgcaatcaatttgattttttacaaagtctgcatctgcatctaaaacaccgtaaactcctgttgtgttttgtgctgttagagccgttattgcactcatcgcataaagtttatgagctgttattgtttttatatcggcttgtattccggctcctccgcttgaatcagaaccagctattgttaaaacctttttcatattattctccttttaccatttctttagataaacttaaaagttcttttgtatcttcagttatatttttgcttgcaaagattgcagatacaactgcaactccgtcaacatgacttccttttaattttaaaatattatctttacttattccccctattgcaacaacgggaatatttacactgtcgcatatttcttttagtgtttcaaaagatacatcatcggcatctaactttgttgaagttgaaaatactgctccgactccaagatagtcagctcccattttttctgcttctatagcctcttcgagagtatgagcagaaacgcctaggattttatcttttcctattttacttctaacgtccgtagctttcatgtcgctttgacctacatgtactccgtctgcatcacattttattgcaacctctacgttatcattgattacaaaaggaatattatactcttttaccatatcttttatttctaatgcttcttttaagaattcttcatcacttaattctttttctctaagctgtaaaaaagttattcctccctctaaagcttctttgatttgcccctttaatcctttttcttcactccacattctgtccgttacggcatataaaagcatatcttttttatctgtgttcatattttgcccccttatcaagttcttcacctgacatattgtaaatagcatcaattaaataatttctaaatgatgagttaccggcttttgtttcaaccattttttcatatgctttttcccctgcatatcccattaaacatacgcttgcaaggcaggcttttaacatattgtctgtatttgcacatatataagcacaagtcatagctgaaagcatacagcctgttcctgttattgaagacattacagcatgtccgttttttattatataagcatctttatcattagttacaatatcaatttctcccgtaactattattacagcacctgtttgttttgaaaattcttttaaagattttattacatcgtctatattttcttcagttactttatcagctatatcggcatcaaccccttttgttgtaccgcttcctgccataagagttttaatttcggaaatattaccttttattacagaaaatttaacgttattcaaaagttcatttgctgtatttgttctaagagttgaagcacctgctcctacagggtcaagaataacaggatgagaaagttcatttgctttttttcctgcaagtaacattgaaggaattgtatttttatttaaagttcctatgtttatatttaaaccgctgcaaatacttgttatttcttctacttctccttcatcatccgccattatcggagaacctccacaagcaagcagtatatttgcacagtcatttacagttacgtagtttgtaatgttatgtacaagtggtgtattgttttttacgttttccaaaatttcttttaacatttcattcctcctaatataaaaaaacgagaaaccaattaggattctcgttaaaatttacttattatttcttcctacgttggcattatccaaatcaggtttaagggtcgaataaattcctctcagcaaaaagctcccctgtatattttatttataaaactatgctaccacaagataaaatatatgtcaacaaaagcattatgcttcgctttccaaatgaattttatctcttatttcttgcatttttatatctgtataagaaataagggttgcacattcttttaattcatttataattttttcttcttcttctatattttttttgtatttaagctgatgttccaaacttgcccaaaagtccattgctattgttctaatttgaatttcaactcttaaattttgttttttatcagaaaagaacactggtatttccacaatcatatgataagatctatatccgttttccttagggttgttaatataatcctttacggctatgacagtaatatcatcttgttttgcaatcatttttgcaagtgcatatatatcatcaataaaagaacaaactattcttattcccgcaatatcatttaggtgttccatagccgattctacggatacttcatatccttctttttttaattttgcggctatactttcaggttttttgattcttgacttgataaactctattggactgttagctcttttaagtgcaagttcatcatttaaaacttcaagtttagttttaacttctcttattgcacagccatacatcataattgcttctttaaattctttagtttgttctataaaatatttttttgtatctgcaggaacgttaacagtgcttataaacgtcctgttcaggtctttttccatgttcattgtaatcttttaatatatgatatttatttccatttatgtccgcagtcaaggcatatgtaatcaggtcttgttttttcatcttcaaaacatccgccataaaatccttcatctttccccattgcttcacaagcttcaaaatacataagaccgtatatcatttcttcaatatgtttgcttttacactttggacatatcttttccatatattattctccttacattttaatattgtatcataaatcgacaatattacatagaacattaattgattattaatgttaatttaatattttataaatgggcttgtatgaaaaaattttttatcctctctggaatatttttaggtatattatccatagatatgttttttaacctatcttcatttccatcttttaaagcctgttcataataccaacatttatattcaatcattgaaagaaccttttttaattcattcatttcttttattatattctctctttgtttataaaacatctcttttcttttttctaatgtttcatttccaagagaacaccaatacataaactctttaatatcttttattttcattccggatttttttaaacactctataagtcttatagcttctaagtcaacatcatcaaagtttcttttccctgatttatccctttttaaatttataaacaaaccttctttatcataaaatcttaaagtatggatagaaatattaaataattttgaaacctctcctattgtatacataataaaactcctatttttttatttttttccttgacatagagttcactcaaggtactacaattataacataaagaaaaataatataaaaggagatatataaaatggtagaagaaaaattaaatttaacagataaatgggataaagtttttgaaaaaagcgacaaggttgaacattctaaggtaacttttcacaaccgttttggaataacattggcagcagatttatataagcctaaagataaagaaggtaaacttcctgcaatttccgtttgtggaccttttggggcagtaaaggaacaatcaagcggactttatgctcaaataatggctgaaagaggatttttaacaatagcttttgacccatcatttacaggtgaaagtggtggaaacgtaagatatatggcatcgggagatataaacactgaagattttcaagcaagcatagattatttatctacaagagatgatgttgacagcgaaaaaataggtattatcggaatttgtggctggggtggaatggctcttaatactgcagcaattgacacaagaataaaagcaactgtttcatctactatgtatgatatgtctagagttgcggcaaagggatattttgatggagctgacagcgaagaagaaagatataaaatgcgtgtagcacttaacacacaaagaacacaagattataaaaatggaagttataaactaggtggtggagttgtagatcccctaccggcagatgctcctttctttgttaaagattattatgattattataaaacacaaagagggtatcatgaaagaagcttaaattcaaatggcggatggaatgtaattggaactatgtctttaatgaatcaacctcttttaaaatatacaaatgaaataagaagtgccgtattagtaatacacggagaaaaagcacattcatgttatttcagcaaagacgcatataaagacatgataaaggataataaatacatagataataaagagttaatgattatacctggtgcagtacacacagatttatatgacagaacagatattattccatttgataaaattgaagaattttttaatatgtatttaaaataaaggaagtaatttatgaatgttttagctataagtgcaagtgcaagaaaagatggaaatactaaaataatgcttgaaacggtgttaaatcagataaataaaaaaggtatagaaacaaatcttattgaactgtcaggagaaataattaacccctgcaaagcttgttttacatgtgatggaaaagaaaagtgttcttttaatggtgataaatttaatgaagtatttgaacttatgaaaaaagcagacggaattattttaggctctcctgtttacagcgcaaatatttcttcaatagtgtaggctatttgaaagagcaagtgtcgttttagatatgaatcccggtttgtttaaacataaactatctgcaggtctaagtgtaggaagaaggggtgggcttttaaatacaatagatacattaaatcattttttcttaaatcatgagatgattgttgtcgggtcaacttactggaatattggttttggggaaatgcctaaagatgtaaatagtgataaagaggcccttgaaaatatgattaatttaggagaaaatttttcttatatattaaaaaaattaaataagtaagggcaataaaatgaaaaagaataaaaaaataaaatatattacttcttttgtattaataattatatttttaataggatttatattttattttacaaacaaaaataaggatgatgtaagtatgaataattttaataactctaattttaatttttcaacaaaaacggttatgttaaacagcggatacgaaatgccactaaatggaataggaacctattccctaaccggggatacggcttataattcagtaagtagcgcacttaaaagcggagtaaggcttattgatacagcttatatgtatcataatgaagaagaaataggaagagcaataagagattcaaaaatcccaagagaagaaatatttgttattacaaagatataccctacccagttttcttctcctaaagaagcaatagatatggctttggaaaaacttgatattggatatatagatatgatgcttttgcatcatcccggagaaaatgacgtaaatgcttataaagaaatggaaaaatacgttaaagaaggtaaaatacattcaatcggcttatcaaactggtatgttgaagaacttgaagaatttttacctcaagtagatataacacctgctttagttcaaaatgaaatacatccttattatcaagaaaatgatgttattccatatattcaagataaaggaattgtagttcagggatggtatccatttggaggaagaggacatacaagtgagcttttaaatgataaaacaattgtagaaattgcaaacaatcataatgtttcagctgcacaagttatattaagatggaatttacaaaaaggtgttgttgttattccaggctccagtaatccagagcatataaaagaaaatacgcaaatttatcattttgaacttaccaatgaagatatggaaagaataaacaatttagacagaaatgaaaaacatgactggtattaaaagaccgattaatcggtcttttttttttatttttatgaataatttaagataaaaaatattacattaaaactatataaagttaaatacaaatatgttaaaattacatcatatatcaaatgctaaaacagattaagaaattacggcatattataaaattttggaggtttagttgtgcttcaaataaaaaatataagcaaacaatataaaaccggaagtttagttcaaaaagcattagatgacgtaagtttgaatttaagagacaatgaattcgttgcaattttaggaccaagcggttccggtaagacgacacttttgaatattatcggagggcttgatagatatgacagcggagatttgataataaatgaagtatcaacaaaagaatacaaagacagagactgggattcttatcgtaaccatacaataggatttgtatttcaaagttataatctaataccacatcaaacgatactttcaaatgttgaacttgctcttacaatttcaggtatagataaatcagaaagaagagaaagagcaataaaagcccttgaacaagtaggtttaaaagaacaaatgcacaaaaaaccaaatcagctttcaggagggcaaatgcaaagagttgccattgcaagggcgcttgtaaataaccctgacattgttcttgcagacgaacctacgggagctcttgacagtgaaacaagcatacaagttatggatcttttaaaagaagttgcaaaagaccgtttggttgtaatggtaacccataacccggaacttgccgaaagatatgcgacacgtattgtaaatttaagagacggtaaaatacgttcagattctgacccttttgaaattaatgaagaaaaccaggttgaatctgtttataaaaaatttggtaaaacagcaatgtctttcttgacttctctttctctaagttttaacaacttaaaaacaaagaaaggaagaactattcttacttcatttgcaggttcaattggtataattgggattgcattgatactttcattgtcaaacggtgtaaactcctatattaaatcaatagaagaagaaacattatccgaataccctttacaaatacaaagttcgggttttgatttaacttcaatgattaatatacaaaatacaaataacgaacaaaaagattcagaaataaaaataaacaaacagcttacaaatatgttttcaactattggctcaaacgatttaaaatcactaaaaacatatttagaaagcgatgaatgtcctattgataactatgcaaaaaatatagaatacaaatacgatgtttctcctaagatatatttacaaaaagatgatgaaataagacaggttaatcctgatataacatttacaagtcttggtataggctccggaacttcaaacaactcttttatgtcaagcatgatgagtacaaacgtatttttccaaatgccaagtgatgaaaatttatatattaatcaatacgatgtaaaagcgggaaaatggccagaaaattacaatgaatgtgtacttgttttatcatcaaatggcggaatgagcgactttttactttatactttggggcttagggattataacgaacttgatgaatgggtaaaagatttttcaaatgataaaaacgtaactgttcctgaaaatctcggtgaatactcatatgacgatataatcggaaaaacatttaaacttgttgataacagcaactgttatgaatatgattcaaattataacctatggcgtgataaaaccgataatacagaatacatgaaaaaggtcgtaaaaaacggtgatgacttaaaaatcgttggagtagtacaacctaaagaagatgcatcaagcatgatgttatcaatgggaatatgttacccacaaagccttacaactcatgttatggataatgcaaaaaacagcgagatagtaaaacaacaacttgaaaatcctgatataaacgtatttacaggtaaaagttttgatgatgaaggaaatgataatgcttttgatatgaactcactaatgcaagttgatacaaatgcattacagtctgcttttaaatttgaccaaagtaagattaaagtagattttggtgatttaagcgggcttattgatgaaaactctctgcctgaacttgacttaaatgatattttaaacgaaattgattttacaataaccgataaagacactcaaaagataattaaagaacttttagagggatatgaagaatacgtaaaaaacaatcctgacagtgacgtaaacaaagtaagtaaaggactttcagaatatttaagttcaagtgaagctaatgacattataaacaaaaggctgaatgaaacaatcaaaaatggcggttccatttcaaatgaagaaatgcagaatatattctctgaagtattagacggatatggcgaatatgcaaaagataatgatttaagcaattctgaagacttagcccaatcaataaatgattaccttaaaaccgacgaagcaagacaaatcataataaagaatttatcagagattataaaatcacaaaacgtggaagaacaagttaatgacattatggataaatacatgagtgaagtaactggtcaaataagttattccattcaagcacaaatgcaaaaaagcatgcaaagtttaagcgaatcaatttcaaatgccataagtatcgacccttcaacttttgcgggagctttcaaaatgaacatgagcgaagaggaactttcggaactgtttacttcccttctttcaaaagaaagcgttacttatgaaaataacttgaagaaattaaactatgcaaatcctaatgaaccaagtggtattgatatatatccaaaagattttgaaggaaataaatcaataacaaatttactaaacgaatataacgaaagaatggaaaaagaaggcaatgaagataaagtaatttcatttacggatatggtaggaacgctgatgagttcagttacaaacatagttgacaccgtaagttatgttcttatagcctttgtatctatttcccttgttgtttcttccattatgattggtgtaataacttatataagtgtacttgaaaggaaaaaagagattggtatattaagagcaatgggagcctcaaagagaaatatttcgcaggtattcaatgcagaaaccattataataggtgctcttgcgggagttttgggtgttggaatctcattacttgcgcttatacctataaataaacttatatatattctttccgatggagcaaatgtaaaagcttccctacctattagcgcagcaataattcttataattttaagtattgttttaacattaataggcggaataattccatctaaaaaagcggcaaaagaagaccccgtacttgctcttagaagtgaataaaaaaaggaaggactgcttggcagtccttttataataattaaatattaagagaaataaatatgagaaatatagaagagctttttaaaaatagaaaaatacaatatgataaacttataaaatacggatttatttgtaaagaaaacacatatacatttaaaaaaaatattaatgacaataactttcaagttataattaacatttcaaagtcaaaaaagacttccaaagtattggatttaatgactaatgatgaatatgtcatggtagatattaaaaattccagcggtaaattcataggtagaataaaagaagaatatgaagatattttaaatgatattattgaaaaatgtagtgtttcaaatatatttaaaaataagcaaacaaaagaagtcattaaatacataaaagataaatatgatgatgatttagaatttttatggaagaaatttcccacaaatgcaatttggagaaataagataaataataagtggtatggtttactgttgattttagaagaaaagaaacttgaaattgaataatggtagagaaattcaatattaatgatttagatattatattagatatttggttaaatggaaatttagatgctcataattttataaataagaaatatttttatgataatttagattatgtaaaagaaatattacctaaaagtgaaatatatatttttaaagaagataatataataaaagggtttattgggttaaataaaggatatatagaaggattatttataaaaagagaatacagaaatcaaggtattgggaaaatacttattagtaaggcaaaaagtctttataatgttttaagcttaagtgtatataaaaaaaataaaaaagctttagaattttatttaaaacgaggctttgaaattaaagaaaaacatattgatgaagatacaatggagttagaattattacttaaatataaaaagatgtagcataagctacatcttttgttttagtcttcaaataattctgttgaaagatatctttctcctgtatcaggaagtaatgcaacaatagttttacctttattttcttctctatttgcaatgattgttgctgctttaattgctgcgcctgaagaaatcccgacaagaattccatcgctttttgcaacttttcttgcgctttcaaaagcttcatcattttcaatggttattatttcatcataaatatttttatcaagagtatttggaacgaaatttgcacctataccttgtattttatgagcacctgctttaccttcagttaatacaggtgatgacttaggttcaactgcaataactttaatatttggatttttttcttttaaatatttaccaactccgcttaaagttcctccagttcctacacctgcaacaaagtaatctatttttccttcagtatcttcgtaaatttcagggcctgttgtattataatgcattttaggattttccatattatcaaattggcttggaataaaactatcttttatttctttttgtagttcttctgctttttctattgcacctttcattcctttacttccgtctgtaagtacaatttttgctccatatgcttttaaaagctttcttctttcaatgctcattgtttccggcattgttaaaattgctttatatccttttgcagctgctatacttgcaagtccaataccagtatttccgcttgttggttcaattattgtgcttccttcttttaataatccttctttttctgcattttcaatcattgcttttgcaattctgtctttaacgcttcctgcaggattgaaaaattctattttggcaagaatatttgcttgtaaattgttttctttttcatagtttacaagttccattattggtgtttttccaacaagttgtgttatatttttatatactttcattttatcctccataaaataaattatttttcttatttcctatatgaatactatgaaataaatatatataatattaaataaaaagtcaagtgaaaaataaaaaaaagcagaaaatctgcttttaaatactatagtttaaattttcatcgctattttttattaaatcttctaatgtaatactgtttacgtaatcttcaattactttatataagcctttccaaaactctaaagttgcacaggctccgcatcttgtgcagttgtttttttcatcttcaaggcatgcaataggggcgagacttccttcagtaactcttaaaatatcacctacggtataatttttaggttcttttgaaagtttatatcctcctttaggtcctcttacactaattaagtattctgccctgcaaagttgagttgtaatttgttctaaatatttgattgaaatttcttgtctttttgaaacttcttttaatgtgatgtatttaccatcgtaattttttgctaaatctgtcataagtctgagtgcatatcttccttttgtagaaatcttcatataaatacctctttataataaaataagctttttataatataacatagtcatgtttaaaaatcaaagaaaaaaaggataaattctgtaaaaaaataaaaaatcaaatgtttgcataaaattttgtttaatattataataattaatatttagtatttagggggatatatggaaaataccagaaatacaattcaaaagaaaattatttttaatacgcttaaagacataaatgggcatcctacggcaaaagaagtttatgaaacattacatactaaatattcaacaataagcagagcaacagtttttagagttttaaataatttagcaagcgcagggcatataaataaaataaaaatattggatagttctgatgtttatgattatataacggatggacatcaacatattatatgtacaaaatgtaatagaatttccaatgtaaatatttcatttgataaaaatattagtagtgaagttgaagaagaaagtaaatataaagtattaagttataacttagtttttaaaggagtatgtagtgattgtttagaaaaagaaaaacatgaataatttttttataattatttttatatgaaatacatgtgaaaatatgtatctttttttataaacaatatttcaattacaagttatcaaaggttttatatagcttcattatcgtttcattatattttcacatttgaaaaatataatataaacagttcaaagaaggaggtcatatattatggatgacaaaattaatgatatgatgacagataatgaagttgataataaatttgattctataacaaatgataatgctaaagaaaaaaaattttttaaaaaggaacataaaagcaataaaaagagaagaaatgctgcttttgctttgattgttgttgcaatgatgactacttcaacatgtttaggttttgtgggaggtgttgttgcaaataaatacttggctacaaataaagctgatggtgttacctcaacagaaattcccgtagcttcaacatcgagtggtgacagtacagaaatgaatgtttctactgttgtaaaagctgttcaaagttcagttgtttcaattgaatgccaaagtgaatcagaagcaaatagatacagttttggagaaagtgctactacaacttttgcgggaagtggtgttattataaccagtgatggatatattgcaacaaataatcatgtagtagaaggtgcaagcaaaattactgttacaactgcagacagtaaatcttatacagctaaacttgttggtagggatgagcaaacagacattgccgttttaaaaatagaagcaacaggattaaaaaatgcgactcttggtaaatcaagctctcttgaagttggggatgaagttgttgcaataggtaatcctttgggtgaactttcaggaaccgtaacaaatggtattgtttctgctttaaacagagaggttactattgaaaatgaaacaatgagtttaattcaaacaaacgcatcaataaatgccggaaattctggaggtggtttgtttgataaaaacggacttcttgtaggtattgtaaatgcaaaagcttcaggtgaaaatgttgaggggcttggctttgcaattccaatagatactgcaaaagaagttatagaacagataatggattatggttatgttaaaggcagagttacaagtggtcttactctaatagatattttagacaaacaaactgcaatgcaatatggagtaaatgaacttggagtatatatttacagtgtagaggaaggttcgaatgctgaaaaagcaggattgaaatcaggatatattgtaacagcggtaaatgatacaaaagttgaaagtgcaagtgtttttaaggcagtaattaataaattagaagttggggatacaataaaagtaaccgtttcaaacggtattaatcagggaagtgtagagtataagttaacagaaaaaactaattaataaatacatgaatatttcaagatgaattcacatattttacacataactttgttaacatttttatataagcaaaatgcttatggatattcgttttaaacgaataattccctcttttaaaaatatgtaatctaatattaccgatgcatttgcatcggtaatattagtatataaggaaaataatgtgatataatatatttaaaattatgggaggatattatgccaaggatattaattgttgatgatgaacctaaaatagcagaacttataaataaatatgctacttttgaaggttatgatacagtagaagttaatgatggtatgaaagccattgagatatgtaaaaatgaagattttgatattattgtaatggatataatgatgccggaacttgatggtttttcggctgtgagagaaataagaaaagttaaagatacaccggttattatgctttctgcgagaggggaagagtatgacagaattcatggctttgaagtaggagctgatgattatgttgtaaaacctttttctcctaaagagctaatgatgaggattgaagcaatattaaaaagaactagacctcataaagataaagaaaaaaatgatgtaattaacatagatggaataaatatagatttagctgcaagaattgttaaagttgaaggtgaagttgtaaatttaactcctaaagaatatgacttacttacattcctcgttgaaaatagagggattgccctttcaagagaaaagattatttccactgtttggggatatgattattacggtgatgacagaacactggatacgcatataaaactccttagaaagaatttgggaccttattctaataaaattgtaactttaagaggagttggatatagatttgaaaaagaagactgatttaagcttaaaatggcgtatgtttaagtatttcgccatatttgttgcagtagtactaatttttttatggttttttcagattgtttttttagatgctacttataaatttataaaaacaaaagaaataaaggaagcagcttcaaagatttctcaaaatttcaatgagcaatatattgaagaaattgcattatcgaaagatttttgtgttttgattttagatagttacggtaatgaagctttttctataaaaacttcatcaaaatgtactatacataaattatctccacaaggtataggatactatgtttcgaaagcaatagataataatggagaatttttggaaaaatctatgctatcaagggaagaaaaagaatttagatttggcaatattattttttcaaaaccggaaagtatagtttatacaaaaatagtaaatgttggggatactttttatgtaatgcttcttgattcaacaatttctcctattaatgcaacagtttcaactttgagggcacaactattttggataacaatagggcttatagtatttgcgagtattttagctttttggatttccaaaagaatttcttctcctatagaaaagataaccggtaaagcaagagagcttgcaaaaggtaattataaagtagaagaatttgatggtggatttaaagaaataaatgaacttgttagtactcttaattatgctgcatcagaaatagataaaaatgaagaatatagaagagaacttattgctaatgtttcccatgatttacgaacacctcttactatgattattggttatagcgagatgatcagagattatcctgataaaacaaaagcagaagatattcaaactattattgatgaagcaaagcgtttaagtaatcttgtaaatgatacattggatatggctaaatatgaatcgggagcagtagagctaaataaaactacttttgatttaacattggaagtaaaaaatattatattaagattatctacttttactgattatgatataacctttaattatgataagcatgtatatattaatgcagatgaacttcaaatttcacaggtaatttataatttacttacaaatgcaataaattatacaggtgaagataaagttataaaagttaatcagattattaattcaaatactgtaaaaattgaaatttcagatacaggagaaggtataccagaagaaaaacttccaaatatatgggaaagatattataaaatagataaaactcataaacgttctgttgtcggaacagggcttgggctttctattgtaaaaacgatattgttaagacatggtgcaagatttggtgttagaagtcaggtaggaaaaggaagtactttctggtttgaattaaaaataaaagataataagaataaagataagaaggaataagctaagcttattctttcttttgtgtaacatatattttacaaaacattgaataatagtatactttatgatataatataatgcagaaaatttatggaggggtaatatgtcaggacattctaaatggtcaacaattaaacataaaaaagcgaaaacagacgctcaaaaaggtaaaatatatacaaaaatggcaaaacttattgcagttgcagcaagagaaggtggttcagatcctgatctaaatgcaaaattaaaagatgcaattgcgaaagcaaaatcaaacaatatgccaaatgataatattgaaagagctatcaaaaaaggtgccggagagcttggaaacagcgtatacgaacaaatcacatatgaaggatatggaatcggtggggttgcagttattgttgaagctttaacagacaataaaaacagaactgccggagatgtaagatattactttgataaaaatggtggtaacttaggaacaacaggatgcgtatcttttatgtttgataaaaaaggaacaattcttgtagataatgacggaagtgttgatgaagaggaacttatgatgattgcacttgatagtggtgcagaagactttgatgtaagtgatgatggttttgaaattacaacacaacctgaaactttttcaaaagtatgtgatgctttagaagaaaatgggataaaaacattatcagctgaagttgctatggttcctaaaaattatacaaagttggaagatgaagaacaaattaagaaatttgaaaaaatgcttgaaatgttcgatgataatgatgatgtacaagatgtatatcataatgcagaacttcctgatgattatgaataataattttataaagccttaaaagatttttcttataaggcttttttatttaatagaattaaacaaattttgtattatatatgaattatcaattatctaaatataatttataatgtataaatcaatttatatttaaaatatattatctattaagatattaaacaaactttatgtagtttgttttttttatgtataaaatttccgtatatggctaaaatatgaaataacaaatatatctgataagaggttgttatggaaaaattaagtaaacataaaattatgttaataggatttttatttttaatatcattcactattttttctgcctgctcttttgccggtatggaaataacaaaatctgatgggaatcaagtaaaagggagcttggaaaataatgaagaaaatgttataactactacgacaacaagtgtaacatttaagcgttattatactaaagttggtatcaaaaaaacagaaacagtaaatatagaagctggaaatgtaggtttaaataaaagccagtttttagaaaaatataaagattggacggttgaaagttttaatgctgattcaattgtattatcaaaaaatatagattcctatcctaaaggttattatttaattactgttaatgaagatactcctgaagggtatattgtagcttattcttttgatgacgatggaaataaaagtattgtagaacaaactcaaactcctattgaattattagacactaatgcagctgaagaaataaaaaaaggtattgtggttcaaagtgaagaagagatgtataatatattacaaaactatgcggagtaagatgaaaatgaaaagtaaaacaatgaagaaaaagacaagaaagaataagacaatgaaaaataaaacaatgatttttattatattaatgtgtattttaatgactacaggtgtttattttgtaaatatttatgccggaaattatgtttattatggttcacctccttctcaagttactcctgtacagcaaaaactaaaaagatggggctattatgatggagcggtagacggaaaatttggttcacaaacggaaaaggcagttaaatattttcaaagtaaaaatggcttaaccgttgatggcaaagcagggaagagaactttggaaaaaatgggactttataatttattatcttcaaattcttcatcttcttattataacttaagcagtagtgaaataaatttaatagcaagagccgtaaacggagaggcaagaggagaaccttacgaagggcaggttgcagttgctgccgtaattttaaacagagtaaaatcatcatcattccctaatacagtaagcgaggttgtttatcaaaatggtgcatttgatgcagttgcagacggacaagttaatttaactccaaacacttcttgtataaatgctgtaaaggatgcaatgaatggctgggatccttccggaggagctttatattattataatcctaaaacagcaacaaatgagtggataagaacaagacctattatcagaacaataggaaatcatgttttttgtaagtaggtgaaaaaatgaaaaaaaatattttgattggatttttattaattactgtagttacacttggtgtttttgcttattttgaaactaaagacagtaaagtgttggcaaatagtatagaaaataactacgataagagtttaaattctcttcttgaaagttttgaacaacttagttcccgactttctaaagttaatgtaagtaatgatgaggaatttataaaagaagagcttataaacttatatggacttaatttatctattaatgaaaatataaacaatttacctataaatcatagtgcagttgttgatgcaagtgaatttttaaataaaacgacaaactattattactcattaattacgactgataaaaaaattacaaaggaaaataaaaaagatataaatgaaatatatgaagcatgtgacaaaatatatcaaaaaatggatgaaatgaacagtgaaatacaatatggcaaagaaggttatgattggattaaaaacagtaatgtatttatggcaaatgaatatacaaaaatagataatacttttaaagctttaaacgaagaggtaaatgaatatccaacattgatatttgatggtccattttctgatgctataaatcaaaataagaaaatatcattatcagataaaataataactaaagatgaaggtataaaaattgtaaaggaacttataggcagtgatatagaagtaacttataattctgatatgaattcaagcatagaatgttttgtatattcctatgaaatttctgatgtaaaatattatgcatatgttagtaaaaggggaggtaaaataataagcataaacagtaattatgatgctgatgaaactgctaacagggtagtaagtataaagcaagcaattgaaattggaaaagaatatatgaaaaagatggatattgataatatggaagaaaattattatgaaacaaatggaaatgttattaccataaattatgcatatgaaacaaatggagttacttgttatcctgatttaataaaagtaaaagtaagtctaacaaataaaaatgttgtaggatttgaagcaacaaattattattcaaatcataaacaaagaacttttgataaagatattttaagtagcgaagaagtgttaagtttgattaatgaagattttgaaataacaagagtaagacttgctgttataccaacaagcacagaagaagaaaagtattgttatgaaataaaaggaaaaaataatgatgaaatttttataatatatataaatgctaaaacaggacatgaagaggatattataaaagtaatagaagctgatgacagtattcttacaatgtaatattttgttgaaaaaggtttttaaagatgatataataaacctttaaatagcaagtcgtttgatcgcttttattttaaaagaggaaagtccgagctccatagggcaacgatgccggttaacggccggttagggtaacctaaaggaaagtgcaacagaaaggaaaccgccttttaaaggtaagggtgaaagggtgaggtaagagctcacaggcaaataggtaactatttggacgtgtaaaccccatcgggagcaagaccaagaaataaccagactttatgtcaggtggctgcccgtcactggttagtggtaggtcgcttgaacttattggtaacaataagtctagatagatgatcattaaaacagaactcggcttatgaacttgctataaagaaacaccttttggtgtttctttttttgcaaaagtacaaaatcatttattactaatgttaattttttattttagattttttttaattatattaaaaatataattaattataaaaacctaaaatattaaagcatctgtaaaaacagatgctttatgttttatttataaaatctgaaaggtgaaacgactgctctgtcaaaagcttttcttgctttttttagtttatccatttcattattgaattcaactttaaattcatctggaagatttgtatttttaaatgcttctttcattcttgccattttttcaaggtatctgtcgagtcttatggcaaattgagatttgtattcatcttctgtataatctttatcaagagtttctttaaataatttttttaaatcttcatataatggaatatttccaataggtgtttcaactgcatcataatctccgtgaattctgccttcagcccaaagtaaccatacttttttatcaagttttccatttaagaaattgccatcaatatcttttaagaaatagtttgttgcatatattcttggaacatgttttaattttcttccaaattcaaaatgtttttcaataaattgtttgaaaggtactgaaataaagtcacaagttgcaagagggtcatgagttcttacaccttcttttccaattgaagccattgtagtttctgattcaatgatgcttcctgttaccataccttgattccaagatgatgattcagctattggaactgttgtatgagcatctcttcctccgaatatcattgcatcaagaagaaccccttctttattatttagattttcatctgcattagcaagttcttctattttcattgtatatcttgcattcttacttgatggaattattccgtattcttttttccattctccgctatggttaaatccttcttcaggaagttcaactcccattttatcccaatatgttttaccgtcacttacaagtgtattagagaaaattacttctcttggagttgttaatgcatcaaatataacaggatcatctttaccatttatttcgtttattattccaaatataccttgttctacatttacggcttttgggtttccgtctatatttcttatatatgttatatcgtcacctacaatactttgtcctgaaatcatagctgtacttgttttaccacatccagaagggaaagctcctgccatatatgtttttcttccatcttttccgtgtactcccattaaaaacatatgttcagctaaccaatcttcgtccattgctttttttattgcaagtctgaaacataatttttttaatcctaaactgtttcctgcgtattggttattacaagtatatacagtattattatttatatctatgtaaattcttcttttatcaatatttttagtaacgccgtttactaattctcctgcactatgaattaaatagaaaaagtcattgctgccgtttaaatttttaaaatctgaataaccttgtctatataaaagattttcgctgtgtactacataagcagaatctgttatttgtaaagctgggatagagaaaattgaattgcttggtcctaggcaatagaatgcaacgtacatttctttgcctttcatcattccatccataattgagtatatttctttaagtccgctgtctctgtttgtccagtttatatcaagtccccagttaacttctttatcaagtaaatattttgtgtttaccttgtctcttgcttggtcaagtggtgaatcaaaatgatatgtatgcccatcaagatttaaaggtgtttcttctccgttttttactgaaatttctttaatataattctgatcttcaatactgtctgttaaaacagtaactttatccggttttaatagtgaaaccatatttattactttttgcataacatatggattttttaattcttcaagtttttttagattttcaacgctaataatatctttcatagttgtctccttcttctttaattgttaaacgtatacaccacatataaataatttactacaaatttgattttttttcaagataagattatttatatatttcaaattaaaaaaggaaaagttatatttattgataaaaaaaggcttttaatgtataataatttaattgtaaaaataaaattaaggagtttaaagtgtctatatttagaaaatttattagttattataaaccttataaaaaactattttatcttgatatgttttttgcatttattgtttcgatagttgatttggctttccctcaaattttaaaatatttgacaggtgggctttttactttagggaaagaaacaatacttaaatatatatggttagtagcgattttaatgttaattatgtatattgtaagaacatacggagaattttttattacatcttggggacatattatgggtgcaaatatggaaagtaatatgcgtcaagatttgtttgataaatatcaaagattatctttttcctactatgatgaaaacaatacaggggatatgatgtccaaacttgtatcagatttatttgatatttctgaactggcacatcatggaccggaaaatatttttatatctacctttaaaattgtaggttcatttattttccttttatttataaatattcctctaactttaattttaatattaataacttttagcatgcttgttttttgtttgtatttaaatagaaaaatgcaagctacttttaccgataatagaaaaaaaattgcaggtgtaaattcagctgttcaagatagtttggcaggtataagggttgtaaagtcctttgcaaacgaagaaatagaacatgataaatttgattatagtaacagacttttcttatcttcaaaaactgcacaatataaaattatgggtaaatatcatgccggtacatctttttttaaaggacttttatatcttgctgttatagtttttggaggattatttgtagcttatggaaatatgaatgctgccgatcttgctgtatatgctttatatataggtatatttattactcctgtggaagttcttataaactttacggaacaattccaaaaaggatatgcagggtttaaaagatttttagaagtaattgaacttaatcctgacataaaagacagtaaaaatgcagtggaacttaaagatgttgagggaaatattacttttaaaaatgtttctttttcatatgaacaaaataataaagtgttaagtaatattaatatcaatattgaaaaagggaagactgttgcattagttggaccgtcgggaggaggaaaaacaactctttgttctttgattccaagattttatgatgttgacagtggtgaaattttaattgataataaaaatataaaagatgtaactttaaaatcccttagaagttcaatcggtgttgttcaacaagatgtatatatgtttggcggaagcataaaggaaaatattgcttatggtaagcctggagcaagtgatgaagaaataatagaagctgcaaaaaatgcaaatattcatgattttattatgagtcttgatgatggatatgacacttatgtaggggaaagaggtacaagactttcaggaggtcaaaaacagagaatatcaattgcaagagtatttcttaaaaatcctgaaatacttatacttgatgaagcaacttctgctcttgataatgaaagtgaaagacatattcaattatctcttgaaaaactttctaaagacagaacaacgcttgttattgctcacagattaagtactataaaaaatgctgatgaaataattgttattgtaaacggcagaaccacagaaagaggaaatcatgtggatttaatgaagaaaaatggattatatgctaaatattacaatatgcagtttgacgggcttgaaaaatttgatatatatgggtaaaaaaggcactgtatagtgccttttttaatccttttttattataaatttttttgaaaaattttctaatgggtctatagtatatttgattaatgtatctcttgaaaaaataaacactaatattaatgttgttataagagcaataataaaagctaacattatcatagaaacttgtcccgtttttactaaaggatttaaaatatgatatcttattggtaatgtaaaaaaaccatggaaaaaatatatacttaaagaattttttcctagctttgttagaatattatttttattatttactaaagaagcaataatataaattaataaaaatgataataagtaataaaaaatatcatatataacaaagtaacgttttcttgaaaaaaacatatcaagattaacatcgcccatagaaaatagtgctacatcaaaattattaatattattttttaatgtaataaacaatggtataaataaaataaataattgataagcaaaatactgcctgcacaaattacaacaacaaatacaattatcattataaatacatacaaaagattatattttttatataaagaagaagcatcatcattgtatttccaaatagaaaaatccttaatataactatattcacctaaataactttcatcatacctttcttgattatatgcgttattctttttttcatcattaatattagtattttttaatgttttttcttttttaatatatttcttttttacaagaaatataccaagtataaaaagaccaataaaaagtaaaaaacagaaaaaaagaaataacatcattttataaggcattaaataattaaaataataataatcaagaacaccatttaaaacaagaagtcctaaagtaattaaaccaagaacagaaatgacaataaggaatattcctaaaacttttcttaaaatattcataataaaaacccctcatacaatatatatttattatatcatataagaggttttctattttataaattattatatgttttatcatctacttcttcaagccattcgtttgaagtactttctcccggaacttctatggaaatatgagaaaaccaagaatctttttttgctccatgccagtgtttaacatttgcaggaattgtaataacaactcccggttttaattcgacagcttctttgccttcttcttgataccagccatatcctgcagtacaaacaagaatttgtccgcctcctttatctgcatgatgaatatgccagttatttctacatcccggctcaaaagttacatttgccaaaaatagtccacaacttggatcagttaaaggatttaaaaaactttctcccttaaaatattttgcaaagtttacatttggttcaccttttccaaatacatttatttcatcaaaattcattttatacctccaaaagtctttttatatatttatactaaaccctggagtctactcaaagtcaatataaaaaaagaaaaaacaatcttaatgactgtttttttctttatttgaaattatatatttaatattatttataaaatctttataattattagatttaattaaaatatttacattatccatatcattcataaagcattcaataaatttgaaaaactctcttatttgattcttttcttccctttttattgaaagcataaaaatcagctgagcttttcctgctccccaagatataggttcatccattattgcaattccaataacattctgtttcccgtaaaaatgaattggatgaggtattgctatcatattattaataagagttgaagataattcctccctttctagaacttctttaaaataatcgtttgtaacaaaatcatttaagagcattgagtttgccattaaagcaagaacatcttccttttttgttaaattaagtttagggaaaaatactttttcactgaaattatccaaaaatttatttggaatacgattatatatactgttcttctttatttcacttattgtctgaagaatttttatttgttcttcataaggaaattctattgaaatctttaaaatagggacttgtgtatctcttatttcatttttatccaaatcacaagtagttaatattaaaataggatcttcttttaaaatatcatttaacttaaatgtaggataaggccctattatattataatcatttgaacaaagatttttaacctgacaagaaagtaaatcagaatagctttttacataatgagaaatgatcgctatattttttttgtttggcgaattatcaagtctaagtctttcaattgcagccgcaagatgtgctgcaacataactcacttcactttcagataattcaacatttaaggtattcttaaatattttatatatatttaaagaaagctcaaatataaaaggatattgtttttttattgtttccaaaattggattttcagataattgatggtattttattctatttattaatgatctaatatggaatattaaccccatatataattcttcatcatttttcaagtttaaattataatcatcttggatactttctatcaataaatcaactattcttgttatttcttttggtaatttatttatctgttcagtatcattttcttctaaaatatgacaaatattaaagaaagaaagttttactgcaagctgctttatctcctcttcttgtatttcgttagaaagtttatcataatctattatttcataaaacattattttagcaatattttcaatgttgttttcaacattaaatttagaatcaaccattccaacaaaagtattattattttgtatccttatctttgctgtatataaatataaagttatatctgcgatgttttgatcatttaatattagtttatttttaagcaaaatatcctttatcttattatttatatctatatattcttcattactaaaaatttcccctgaaaattcaagttcattttttttgctgttatagttcatcattaaaatttcatttattaaaaatcttattgaaatttcaagtcctgcaatttgtatatgatttttttctcttataagcattacaggaggatgaacatttgaaagcaaagccttgattctttttatatcattttcaagagtactcctgcttatataaaataaatcttccaaatcatcaagtaaaattgattttgaatttaacaacaaataaaggaaaatatcataaagtcttttttcattgttattttgaaatgaatctttttttgaaagcatacttatcaataattcattgtcattacattcaagcttataccctttccctctttctgaaataatatttgcagaataaggttcaatatcataatttattatacttatatcgtttcttattgttctatcactgacaccgagtttttctgataatgcttttcccgtaatccagtctttcttttcatttaaaattctcagtatcgttagctgcctcgattcattgtatttaacgttcattgatactctccttaataattttaattaattttacattatataatattcattaacaattaatttttttctgcttccaaaggaaaatttatatttctttttgttatcaaatataaaaattatttattataatttattttttttaaaataaatactaatatacttattttataatatttttttatttttctttccgttaaattaggaaagcttgtatttgtaacttactttcttaaaaaatataatcctattaaatattatacttaggaggataaactatgaattacgaaaaaataagaaaagaagtattggaggcatctttaaaatcaaataaacttggacttattcatggaacaagcggaaatatttccgttagagataaagaaaacaatgtttttgcaattacaccaagtggaagagaatacgaaacaatgaaacctgaagacattgcaatatgtgatttagacggaaactggatagaaggagaatacaaaccttctatagaagcaatgatgcacgcaggagtatataagaatagagacgatgttaatgcagttgtgcatacacattctaaatttgcaactattatgtcaatgagagacggtagtcttccaagagcaactcttcctgcttgtatgtattatcctattaacattgcagcaccattttatatggcaggcacacaagaattagctgactgcgttgtagaaacattgggagacagaagcgatgtagtaataatcaaaaatcacggtttacttgcaacaggtaaagatattgatgcagccatgacatgtgcaatatatacggaagaaggagcagaagctgcttattactgtgttcttgccggatttgatgattatattcctgaagaagaagcaattaacttaaataaatcttgtaaaggagaataaaaaaatgctaagagattttaacttcttacttcctacagatgttcgttttggatgtggagtaagaaaaggtattttagaatgcgtaaatgctttaggtataaaaaaaccttgtatcgtaacagatagttttctaatatcttcaaaatatggtcaagagctaaaagaaaaattaccaaatgcagcagtatttagtgatgtcatagctaacccaaatatagaaacaatatcaaaatgtacaaagttttgtaaagataatgactgtgacggtctcattgctttaggaggcggaagttcaatagatacagcaaaagtaacaagcgttgtaattaaagataataatccaatagatttatatcttgatggaaaaggagaagataaacttgaaattaaagaaactcttccaataatagcaattcctacaacttttggaaccggttcggaagtttctcaatttgcggttattacagatgaaaatacaaaaagaaaagactcaataacatcatcaaaaatttacccggtatattcattaatcgaccctgaagtatcttatgaattaccaagaaatttaacaatatcaacaggacttgatgttttatctcatgcgatagaatccttaacaggtaagctatataactctcttacagaattaatggcaagagaagcaataagaattatttttgaatatcttccaaaatgtttggataacgataaaaagcaagaaatgaagtagcatttgcctcaatgcttgcaggtattgcaatgagccattgctgcggaacacttcctcatggtatgggatgtcctttatcaggacattgtaatgttcctcatggacttgcatgtggagtaattcaaatacctacaattgaaatcgtcggaaaaacatgccatgaacaacttgaaatattaatgaaatatatagattcaaactttaaagcagaagatgaaagctgtgcttcaaaagcattaatcaaaaaaataaagactttatttgatgaacttggaatagacggaacattaaaagactttaacttaacagatgaaaaaataaaagctatggttcccgatgcaaaaatacatggatgcacaggacttactatggaagaaattgacgaaaacacaattgaaaaaatttatcaatcattaaaataaaaaactcctaatggagttttttattttatttcaaagccagcttttctaatagctttgtaaatttcttctttatcaatttccctatcataagaaatttttacaaatccttcttcataatcagcatgagaaaccaagccatctattttatttaattctatttgaatacttttttcacaattcttgcagtgcatacctgaaatttttattgtctctgttccaataacaggattttcaagtttcttttgaggatttataacagtctttgaagaacctgtacaacaggaactttctcccttaaaatgttttattgttccttttactgcaaaaatcaataaacaaacaacaagaattaatattattatatcaatcaaaatatcacctcttattattatttacgaactgcctatcttttttatcttgttttttcttttttataaacatatataattgatataaactcatacctactatataaatgactataaccaaaagaaaaaaccaaaacattgaagctgtagaattacccatttaaaacctctttatttataaatattttcaaaagaagaattagaacaagaactacatccgctgcagccactgcagctacatacacaaccaccattttttttctttttaaagtggttatataaaacaaaagcactatatccaataattaaagctattattataatatcaatcatttttatttcctccttaataaaaagtcaggcatatatttatacctgacttaaataaaatatattatgctccttgtacagatctttttgcatatactttttgatttttgtatgggtcaggtcttagtaattggaataatattaaagctgcaagtacaaaagctattaaagtaagaaccgtaaaaggaccacccagtataaatgaacctatttgatatacacataagcaaacaacatatgcaaatacgttttggaataaaatagcaaaccagaaccattttcttgattgcatttgttgtgccattgttgctattgccgccaaacatggagagtcaagcatattaaacaataagaaagagaatgcggcaagcgttgatgggaaccaagtctgtacggcttgtgctacggtaattggatcttcacttgcactttccgcaacacttgcaagcacacccattgtagaaacaatcgcttctttagccgtaaaacctgaaagtgacgctgcaaccggttgccattcaccaaatcccaatggagcaaacaaaggagctattgcacctccgataacggcaagaagactgtccttactttcaaccatcgtaaaacttccgtcaacaaatccaaatccgcctaggaaccacataacaacacaagcaaggaacaaaattgttccggcttttattataaatccttttaatctttcccaaacatgaagtaacactgtttttacttgcggaatatgatattgaggcagttccataacaaacggagccggttttcctgagaaaggttttgtctttttaagcataattgcagaaacaagaaccgcaactattccaagaaagtacatcaaaggagcaacaaatccgcctgcttcataacttcctgttgcataacttgccataacaccgcccattaatgcaataacaggtaattttgcaccgcatggaataaatgtagcagtcataatagtaagtcttctgtcattatcctgttcaatggtttttgaagccataataccaggaataccacatcctgatgatattaaaagtggaataaagctttttcccgataaaccaaaatgtctgaacactctgtccataacaaaggctatacgaaccatgtatccgcagtcttcgagaattgataaaaacaggaataatattgccatttgaggtacgaaaccaagaacagcacctaccccgccgattatcccattaacaacaagactgttaatcaaatcagatgcacctatatttgttaagaatgtttctgcccatccttgaattgcacccacaaaagtatcgtttgtccagtcggtaacaaaagtacctatggtagtaacggatatataataaacaacaaacattaccgcaataaaaattggaatacctaaaatacgattagtaacaattttatctattttatccgacaccgttaatttttccttaccctttttaacggttgtcttaacgattttttgaatatatttatatctttcatccgttacgatgctttccatatcgtcatcgtgtttttcttctatgctttttcttttttcttccaaaacttttttcccttcggaagaaatatgtatgttttccataactttactgtcattttcaagaagttttacactgtaccatcttttcttatcttcacttatagaatttggaattatgccttcaatttctttaattgcactttccagttcttttgagaatatttcatttggtcgtttaacttcatttttctgtgcaacttttattgcttcgttaacaagtttatcaagtcctgttcctttaagagcagatgtttcgattacagggcagcccataagcatagataacctttctgtgtctatagacattcctcttttttctattaaatctgccatatttaaagcaattacaacaggtacaccggtttcgattaactgtgtcgtcaaatacaagtttctttctatatttgttgcatccacaagatcgattattacatcgggattttcctttaaaatataatcacggctcacaacttcctctaacgtataaggtgaaagagaatagatacctggaaggtcggtaattattatatcttccttcttttttgattttaatttaccttcttttttttccaccgtaaccccaggccagttaccaacatattgattggcaccggttaaagagttgaacattgtcgttttaccgcagttggggtttccggcaagtgcaattttgattgccattattttacctcctagaaattgattgttttagattgttttaaactactttacctgtacacatttggcgtcttcttttcttacggaaagctcataaccccttaccgtaatttcaacgggatctccgagaggagccacttttctgatataaagttcgcttcctttagttattcccatatccatgatacgccttttataagcactgtctccttcgatttttacaacagtaacactacttcctacttttgcatctcctaaagtcatttttatctcccttcataagttttatatttaaaacactaaaccattatatgtttggccatatctttgttaattgcaactctagaatctttaatatttactattacatttcctccaatcatggatataacagtaatttcacttccgttaacaaaacctaagttttctaaaaatctcttggtttcttcattaccgcttacccttttaattgtttcaacacttcctatatttaccaaatttaaaggcatcatttaccatcctctcttattatgaataaagttattgtaagttttcatttatattttcaatattgttagctatcgcttacatcttactaaagttagtatatgctaacttgaaaaataagtcaagtaaaatttggaattttttatttataaaactgctaaaataaagggaataaataactaatcttaaaaaaccaataaagaaaaacaaataatataatggaaataattgtaaaattttcattaataataaaaaagacaggtatttctacctgtctaaaatttttaattaaatactttcatggaaagttctcttgataacttcaagttgttgttcttttgatagtctgttgaagttaacggcatatcctgaaactctgattgtaagagttggatatttttcaggatgatccattgcatcaataagaacttctctgttcataacattaacgtttaagtgatgtgctccttgatagaagtaaccatctaaaatatttacaagattttcaattctttgatcttttgattttccaagtgcatcaggtacaattgagaatgtatttgagataccgtcttggcatacatttctgtatggaatttttgcaacagagttaagtgaagcaagagccccgttaatatctcttccgtgcattgggtttgcaccaggagctaaaggttcaccaacttttcttccatcaggtgtactacctgttttcttaccatacataacgttacttgtaatagtaagagcagaaagagtatgaattgcatctctgtagatatgatgttttttaagttgtttgaagaagtatgttacagcatctactgcaagtaaatctactctgtcatcatcatttccgtatttagggaaatctccttcaatttcgaaatcaactgcaactccgttttcgtttctgattggttttacttttgcaaatttaattgcagaaagtgagtcggcagcaacagaaagtccggcaataccaaatgcagtaattctttcaacatctgtatcatgaagagccatttgaactgcttcataagcatatttatcatgcatatagtgaatgatgtttaatgtatctacatatagttcagcaacatatgaaagaacttttttgtagttttccattactttgtcaaaatcaagaacttcatctttgataggttcaattcctggaactactttaattccttttaattcatcaaccccaccgttgattgcatataaaagtgattttgcaacatttgctcttgctccgaagaattgcatttgtttacctattgccattgctgatacacaacatgcaataccgtaatcatcaccataaattggtctcattacatcgtcattttcatattgaatagagtctgtgtcaatactcatttttgcacagtattttttaaagttttcaggtaaatgttcactccaaagtactgttaagtttggttcaggagcagttcctaagtttgttagagtatgtaagtaacggaatgagttttttgtaaccaatgtttttccgttaatacccataccacctattgattctgttacccatgtagggtctccgccgaataattcattatattcaggagttctaaggtgtcttacaagtcttaatttaattatgaattggtcaattaattcttgagcttctttttctgttattacattgttttttaaatctctttcaatgtaaatatcaaggaatgtagaagttcttccaagagaagtagctgcaccgttattttctttaataccggcaaggtaaccgaagtataaagcttgtacggcttcttttgcatttgttgcaggttttgaaatatctatgccgtaagacatagccatatttttaagtctgcctaagtttctgatttgttcgcttacttcttctctaagtcttattctatcttcactcattggaccatctaagttttcaaggtccatttgtttttcttcaataagcttgtccacaccgtaaagagcaactcttctgtagtcccctattattcttcctcttccgtatgcatcaggaagtccagttaaaagccctgctgttcttgcaagtcttgttctttttggataagcatcaaaaacgccgtcattgtgtgtttttctgtattctttaaaatgtttttcaatatcttcgtttagtttatatccatattgttcaagggcagaagttgccattctcattccaccataaagatttacaattctttttaatggagcatctgtttgaagtccaacaataacttcattgtctttatctatatagccaggtttaaaattttcaataccggatacggtatctacttcaacatcaattataccttttttaatttcctcaacgattaagtcatgagcttttgcccaaactttatctgttttttcagttgttccttctaagaaagagtcatctccttcataagcagtgtagtttctttgaataaaatctcttacgtttatttctttttcccaaacaccgcttttaaaatcataccatggattagtcatataattcctcccttgacttaaatttatttattaaaaaatatcttttgatatttttcaaccacatctttttccataggttctgtatcctctaggggataatcaatacccatgaccttatacttttcccttccaagctgatggaaaggaagaagttcaactttttcaacattttttattgtatcaatatacccttttaaagctttcatatgttcttcactatctgtaagcccaggcacaacaacgtgccttatccatattggtatattgttttcttgtacttttttaataaactttaaagtttcatcttgttttcttcttgttatttcattatatttttcataatcttcatgttttatatcataaagaattaaatctgtatatttaagtatttcgtcataatcacccttaccataccctgcggtatcaatgcaagtatgaatatcattttctttacatttttttaaaagttcaagcaaaaattccggctgcattaaaggttcccctccggaaaaagtaactcccccgttatttttaaaataaggtttaaaacgctttattttatttataacttcatctaccgtcatttcttcacctgcacataaatcccaagtatccggattatgacaatattggcatcttaaattgcaaccttgtaaaaaaactacggttcttatacccggtccgtccacaagtcccatagactcaatagagtgtatttttcccattttgcctccttagaaattaagcattttttatttttcttttattaattatttaaccttttattatctcctctttataagtattgttaatcaaacaaatatcttgtttagattattatactataaaatgttagttattgctaacatttttttctcgaattgataaatttttaaatttattatataatataaaaggtctacaaatattgtaacatatgcataaataaaaagatagaggaatatcatggttagttatttatcaaagaaatttattaaagattataaaaatgtaaaaaatgaaaatgtaagaagagcttatggaatgttatgtagtatagtaggaatattactaaacatttttttgtttgcaataaaatattttgcgggcataataagcggctcaatagcaataacggcagatgcttttaacaacctttctgatgcaggttcttcggtaatcactcttataggttttaaatttgcgggaatgaaaccagactttgaacacccatttggacacggaagagtagagtatatttccggatttgctgtttctgtaatgattatactgatgggagccgagcttttaaaatcatcaattaataaaatttttcatcctgaaagtatagatacaactgttgtttcatttataattttaatagtttcaatacttgtaaaattatatatgtctttatacaacagtaaaatcggagataaaatagaatcagctggaatgaaagccacagcaacagacagtaaaagcgactgtatagcaacatcggttgttttaatatcaatgttaatagcaaaatttacgggagtaaacatagacgcatatgcaggtttgcttgttgcaggatttattctttatgcgggatatgatgcggcaaaagaaacattaagccctcttcttggtcaaattccggaaaaatctcttgttgattcaatagaaaaaattgttatgagctacgatgaaattgtaggaatacatgaccttgttgttcatgactatggtcctggaagacttatgctttctcttcacgcagaagtaccgggaaatggggatatctttgttcttcatgatgcaatagacagagcagaaatagagctcaacgaaaaattaaactgtgaagctgtaatccatttagaccctatcgatacagacaatgaagaagtaatggaaatgaaaagcaaaattactgatcttatcaaaaaagaaatagatgaaataattacaatacacgattttagaatggtaaaaggaaatactcatactaatgttatttttgacgcggttataccgccaaagtataaaatgacagataaagaagttgaaacaaaaataaaagatttagtaaaaaataattttgaaaattactttgccgttgtcaaagtagaaattacatatgtttaaaaatatccctctataatttttatagagggttttatttaataaaaggaggtttatatgaatactaattatttaaaactttctgatgaattacaaaaacaaataataaacgaccgaaaagaaaacaaaatcaatccctatgcttttaaggatgaaaatatattaagaagggatatgaataaagataaagcaactatttggagacctgcatttgtaagagacatagaaaagacaatgcatataccttactataaccgttattcagacaaaacccaggtattttctttatataaaaatgacgatatatcaagaagagcttttcatgttcagcttgtttcaaggattgcaagaaatataggaaaagtactaaacctaaatatagaccttatagaagcaatagcacttgcccacgatataggacatacacctttcggacatggcggagaaagaatattaagtgaaatatatcacgaaaataccggaagatattttaaccataacgtgcatagtgtaagagtacttgataaactatcaaaccaaaacatatctttacaggttcttgacggtgttctttgccataacggagaacttgaacagaaaaaatacaaaccctgcacacttaatggatttaaagaattcgatgaaaaaacaaataaatgctacattgatgaaaaatatatatcatctcttctaccatcaactttggaaggctgcgttgtaagagtaagcgatattattgcttatcttggaaaagacaggcaagatgctcaaagacttcatattttagaaaatgaaagaatttttaagaaaaacaaaatgggaaatacaaattctgaaattataaataatttatccgtaaacataatacaaaatagttacggtaaaaactatcttcaaatggataaagaagtttatgaagcactaaaatggggtaaaaaggaaaactacgaattaatatatgaagacagtaaagtaacaaaagattacgaaaaaaacataaaaccaatgttatttggtatttataataaatttttaaaagaccttaaaaataaaaatacaaattcacttatatatagacatcatattaaatacgtagaaaattttagtaagtttaaatataacgacacagacccgaacgatattgtcgtagattttatagcaagcatgacggatgactattttatagatttacatgaatatttattcccaaaaagcaaatataaagtaaaatatataggttattttgaataaaagcaagaggataaaaactcttatttcttttatagaaatatttagttttctgtataaagctatgtcgaggatttcaaatattgatgaaacatcaaactctctataatcattttctttatttctttttaagtttattaacccttcgctttcccagtatcttagagttgatcttggtatatttagaattttggaaatcagccctatattatatttgttttccattttattacctcaaaattaattttatctatattatatatattttactcttgacattcaagttacttgaaggtttataatgttcaaagtgaaattataaggaggaatgaataatgaataataatatagcaaaagaatttaatcttatatctttaattaagtttagttttcccactattattatgatgctgttcatgtctctttacacaatagttgacggagtatttatatcaagaatagtaggggttaacggactaagtgcaattaacataatagaacctcttttaaatttatttttcggggttggaattatgttcggtaccggaggaagtgccataatagcaaaaaagatagggcagaaaaaagacgaagaagcaaatggagatttatctcttattgtaattacaattgttgtaataagcatgataatgtctattttttctgtattatttttagataaaataataaattttttaggtgcaagtgaaatattatttggatattgccatgattatttgaacatatatttaagatttgctccattactaatgcttcaacttgtatttagcagcctttttgtaactgccggaaagccaaacttaggactattttttactgttcttgcaggaataacaaacataatacttgattatgtatttatggttcctttaaatatgggaataaaaggtgctgcatggggaacggttattggatatatgattcctacaacatcgggattaatattttttataataaacaaaaaaggacttcatttctcaaagatagataaaaaccctaaagtaataactgaagctatgtttaacggtgcatcggaaatggttgggcatatttcaatgtgtattacaaactggatgtttaatatatcattaatgaaaatgcttggagaaaacggagttgccgcaatatcactgcttctttatgcgcagttcttgtttaattcaatgtatatgggattttcaagcggggttgctccaatatttagttataactttggaagcgaaaacaaaaaacagcttcaaaaagcctttaaaaacagtattagaataattttggtatctgtaatatgtatatttattctatcattgttattctcatctaaggttgtaactatatttatacctgtaaacagcgaagtttatccaatagcaacaagagcatatttgttattctctataacattcttgttttcaggatttaacatttttgcctctgcaatgtttacagctctttcaaacggtaaggtttcagcgataatatcatttatgagaacattcgtttttatatcaggtgcaattatgcttcttcctttatttataggagttgacggaatgtggcttgcaataccgacagcagagatacttgcattaatggtttccttgttcttcataattaaagaaaaaaacagatataattatatttaatatttaataatctatccctttttatttgtgatataatattaaaatagtttatattttggaggaaagtatggcaatagatttagtaaaagaatattttgataaatttaatatgaaagataaagttatggagtttgaaacttcaagcgcaacagtagagcttgctgcaaaagcacttggaacaacaggagcaagaattgcaaaaactctttctttttatgataaaaatgaagaagaaggaggatgtattcttgttgttgctgcaggagatgcaaaaattgacaataaaaaatttaaaacaagattttcacaaaaggcaaagatgttatctatggaagacgttgaaaaatatacaaatcataaaataggaggtgtatgtccttttgcaaaccctgaaaaagtaaaaacatatcttgatgaatctttaaaaagatttgatacggtatttcctgcttgtggaagttctaattcagcaatagaacttaatatggaagatttgtttaaatattcaaatgctttggattgggttgatgtttgcaaggactggtaataatggattttaaaattgaacaatgggatttaaaatatgtagatgatgtggtaaaatacgcaaataataaacgtattgccgataatttaagagatatttttccttatccttatacaaaggaaaatgctgaatttttcataaaagactgtattaataatgatattaacaatatattaaaagccataacggtaaacggaaaagcagtgggaagcatatccgttataaaactaaatgatgtaaatagaaaaactgcagaaataggatactggataggggaagaattccaaaataaaggaataatgaaaaaagctgtaaaaatggttataaaagaagcttttgaaagaatggatatagtaagaattgaagcagaaatatttgaaacaaatatttcctcaaaaaaagttctagaaaataacggctttaaattagaaggcagaaaagaaaaaagcatatttaaaaatggtaaaataatggatagcttaatttatgccattataaaataatatacatatgttttataaaaaaaggatacttcaaaggaaagtattctttttttaggaaaattttagattatattaacataaaattactacttataatgatacaatatgaacaatttattaaagattacagaggaatgacatgcattttataaaatctatatttaaagtgttaaccatagtatttttatttttttatttatcaaggtctggggtatcccgtttagctagtttaccgttattatatttgtgttttgcaacattacttgtatgtaaagcaattgaatttagaaaaaagagaataaaattaggatttttcttttgtataatattggcagtaatattttacatattgttactcattaacagcatacatttaattttaaaataagtataaatcagtattgtaaaatagtataattctagctataatatatacgaacaaaagttctaaaggtggtatatatgatagtaaaagaaattgaatgtaaaagtgccataaacaagatttcaaattcaagacttccttatagtctggatttaaatatttacagaggatgttctcataaatgcagttattgctatgctctttattcaaatagttacttaggttcaactgacttctttaatgaaatatttgtaaagaagaatattcttgaagtattggaaaaggaacttagaaagaaaaaagacgataaaatcataaatatgggaagtgtaacggatgcatatcagcctttggaagaaaaatatggattaatgagagaagtactaaaacttatgattaaatataatcagccaattataatttccacaaagtccgatttgattttaagagatattgatttaatcgaaaagctttcaaggaaaacgtatgtgaatattgcttccacaataacagtaatggacgaaagaattagaaaattaatcgagccttattctaaaagcagtattcaaaggataaatatgttaaaagaaataggaaagacaaatgcaaatactgctattcatatgatgccaattattccatatattacagatagtatagaaaatatagataaaattttttatttaggaaaacaaataaacatagattatattttaaccggacctttaaacttaagagggcagacgagaagttattttcttaattttattaaaaaaaattttagtgaagaatataaaaaaatagagaagctttatgaaagttcctctattttaaataaagaatatttaacaaatcttaatagaaagatatattgtataagaaagaaatataatattagttcaaattatatgaaaaaaataaacgaacattataataatatagaacagctaagtctgttttaattatttttcttttattctaaatataaaataaaatataagtgctattactcctattccaagaaaggttgatttaaccgtttcaaataaattaggaagagtaataaacttttgtaagattcctataacaagttcaagtaaaatgaatataaatgccgtattaatggcaattctgcttttctccatactttttcctttcctgtcaatttgttttataattgacacttaaacacgtttagaatgtactgaattatttttgttttctttgagcgatgaagccattcatcataagtaatttcatcgcagtctttcataatatcatcaatctgtgtttttatatctttaatgaaaggtttgtctgttataaaaactccgttttcatattgaatataaaaacttctgaaattcatgtttattgtgcttattattcctgcaaaatcatttaagataattttactgtgcaaatatcctttgttgtattcataaattcttacaccgttttttaaaagtcttccaaagttaaactcacttaaatatttgtttgttttcttatcgaaatgttttggtgtaacaattcttatatctacaccgcttttaccgcataaacaaagtacgtctatcatttcatcgtctaaatttaagcaaggtgttgttatatataaagtattttttgctgtatttataagatatttatacatatcttccgcaaattgaacataatttgaaggtccgtctgcaaaaggctggcatattacatcatttcttatatcatgacttggtctgtatttttctatatcacttattttatggtcagttgtattccacattcctataaatactaatgtaaaactccaagttgcatctcctgtaattttaagagaacagtctttatagctttcatgtaagatgttattccaattattatcttttatgtcgattccgcctgtataagatatgtttccgtcaattataattatcttttgatgaagtctataattataatattgttttgatgcatttttgtgtattgcattgaatatggtaacttctattccttgttcttcaaggcgtttttttacatttgcggggatttttaaaatagaccctacatcatcatacattatctttacttcaacaccttcacttgctttttgttttaaaatattaaatattttatcaaacaaatcaccttttgaaagagtaaaaacgcttataaagataaacttcccggcattttttatatctttaactatattttcaaaggtttcttctccggaataataaaagtcaagtgaattatttttataaggagggaaggagtaattggtaagatatgaagataagcgttgtgaatcatcatcttccatttcacttaaaacttttccgtccatattttgataagaatttaccttatctatttcatcctgcattttagtatgttttcttatatgtgaatgagattttccccataaatcatacataatatgtccaacgattggaagaagcagaactataccaatccataacattttatatgcggagtttctttcatcggccattaaatgaattaaaaccaaaatactaaatatttcaattattacataggcaaaaacagcatgtttttttaataaatacgtaaaaataaacataaaaaaaatttgaataataaataataatattataaaaaatattcttaaaaaagtatgaacacgacctaaatgtttttctttcataaaactacctttcaatataaaaagtccgatataaaatattttaatatcggactaaattttatttaattaatttatcacttgaagaagatactgcaattgcaccgctttttatacaatcgataacttcttctttatattctattaaaccacccgatattataggtatattaactttttcttttatttttcttattgcttttggagcaatccccggtaatatttcaacaacatccggttttacttcttttataagttttgaacaagatgaaattgtaggggagtcaataacaaaaactctaagtatgcttattaagttaagtgattttgctttatttattattgatttttttgttgtaagtattccatcgggttttgtaagtttataaatgtattccagtgccaaaggtgaagatgaaaagcccggtattaaatcaacatgtataaaaacaagttttccagctttctttatttttcttacctgttctattaaatgattcatatctatatgaattataaatactgcttctgctttgctttttatggctctgtcaacttcttcttccgttctaacagatgcaataataggatttctctttagtgcttcaaaaaaattattgttcatatgtacattatcctccaaattcctgatatattatatcattaagaacaaaaaaaataaacccaatataactttaaattatatcgggtttttaatggattttacattttattattatttattaattatctcttgttacaacaaggtcaacaccggtaccgcagatatcttttttagcaatatctccgattttaacaggggattttaaagtaatactgtttatttcgtccattacttcaaatatttttgcttttggaacagttccgtttgttcttacgcttgttacagcgtctttccctccttcaacttttactgttgaagttataactcttttaggttctacaacttcttctcttgcgtatttatctcctcttggacagaagttgccttctactgaaaatacttcttttccttcgtattcaactgttaaactacaacctcttggacagcatatacaagttaattctcttttcattattctgcctcctcaatttcaaatgtaagttcgcctttttgatctttgattaaatcttttttaattgttatgttaatcatttcaccaggtaagaatttaagctctttctttctgtatatttcttcaccgtttagttttacaacaacaaatcctgtaggaacaaccctgtttactctcataaacattgatacatcttcatctaaatttgttgttgaaatattttgaggaatagtgtaagagataggaagaactgcttttgtttttaagtcttcttttattttatcgccgtttttaatatactcagctgcaccttttcctgcaataaatccttctgttgaaacgaagtcaaccatatcgtgaacttgtaaaacattaccgcaggcaaatacaccagggatacttgtttgtctgttttgagatacgaatggtcctcttactttagggtcaatttcaattcctgccatgttagaaagttcattctcaggaattaaaccaactgataatagaagtgtatcacaaggaattgtttcttctgttccaggaattggttgtctgttttcatcaacttttgcaactacaacagcttctaatctttcgtttcctttgatatcaacaacagtatgagcaagtttcaaaggaatgttaaagtcatcaagacattgaactatgtttctttgtagtccgttagagtaaggcattaactcaagaacacattttacttttgcaccttctaatgtcattcttcttgccataattaatccgatatcacctgaacctaaaataacaacttctttaccaaccatataaccttccatgttgataaatctttgagctgtaccggctgtcataacaccgcttggtcttgctcctggagtgtttaaggctcctcttgttctttctctgcatcctgttgcaagaataacagctgtaggttttattgtttgatatcccatttctttattaaggaaatgaattgttttgtcttcttcaagttttataaccatagtgtcaagcattacatcaacaccaagttcttcaactgtttttatatctcttcccgcatattccggacctgctaattcttctttgaatctgtgaagtccgaaaccgttatgtatacattggtttaagataccgccaagtcttacgtccctttcaagaataagtatatctttaactccgttttcttttgcggcaatcgcactgcttagtcccgcaggacctccgccaataataactaaatcgtaatttttcatattagtttttgcctccctttccaagctttcctgttaggatataagactctttaccttttttagtaacatcttcgtagttcattccgtattctctcttaatgatttccattactcttggagaacagaacccaccttgacatcttcccatgccggctctcattcttctcttaacaccatcaagagttgttactttaatacctctgtgtaatacatcaacgatttgaccttctgtaattgtttcgcatctacaaattactcttgcaaatcttgggtcttttttaataagttcgtttatttcttcttgtgacatttttgccatgtcaacatatcctcttctgttaggattaaagtctttgttttcttctaaacttagtcctgcttcttttaatatatcaacaagcatttctgctattgcataagaaacagtaaatccaggagactgaattgctgcggcattgataaagccttttgttgagctttcttcgattatgaagtcttgagagtctgttacggctcttagccctgcaaattgtgtaataactttgcttttatcaagtttatttataaggaatctatctgtttgtttccaaacatcatctaaagtttttgcgtctgttgaaacatcttctttatcatcaacatattctgcatttggtcctacaagtacgtttccgtcatgtgatcttgtaagagcaataccttttgaatgagcttttggagtagggaatataaccgggtgaactttactagattcacatgtatcaagtaacatatattcgccttttcttggtgtgattttaaagtttgtttcacaaatcatgcttgaaattttatctgcataaacacctgctgcgttaataacgtattttgctttgtattcattatcttttgtttttactgtgaatacattatcttcttttgttatgtcagttacttcttcgtttaagaagaattctacaccgttatcaatagcattttcagctaatgcaacgcagtattggaatggcattgcaatacctgctgttttacagtacaatgcagctttaacttcgtttgaaatattaggttctatttcatgaattctatcaatatcgattatttctgtttctacaccatttttatttccgttttcttgaagttttttaagtgtttcaatatcttcatcatcaaaagctaaaacaagtgaaccgcatcttgtatgaccaaagtgaagttcattatcaagaattgtaaaaagttcgtttcctctttttgataatttagctttaagtgttccgtatgtagcgtcataaccaccgtgaatcatgccggaatttgcttttgatgtcccacaagaaacatcttctcttctttcaagtactgctatgtctaaattgtacttagaaagttctcttgctgctgaacagcctacaacacctgcaccgataaccagtacatcataaatttctttcattacttcctccttataaatacaaaaaaacaacataaaacacctacgaatataagtgtaatatgttgcggtttctctatcattctcttccgctatttaattgtacattttttatttttgtatattatatatcttttcgtaaataatttcaatagttttgtgttacttttgtaaactttttttatttatatggaaattgtcatgatttgattatattgatagacctatataaaaagggaattctatacatattttactgtatatttttcatttaataattactatttataatgattataagtttacctctatatttatttatacaaaaaatatttatgtaaaatagaatatatatttataatttaaacacaaaaagcacctatgaaacatcataatgtttatactatataacattaaatttactttacaaaatgttgaaataatggtaacataattatgttattaagatttaaaaaggagatacgaacatgggaaaatacggtgaaagagcaaaaaaatttcatgatgaaaaatataactgctgccagtctgtagttttggcatttagcgacgaaattggaatagaaaaagacaagcttgcaaaacttgtagcaaacatgggcggtggacttggatatgcaggagaagtatgtggtgctgtttcaggtatggcgatagtttcagggtaccttggtaaatgggatattccaagtgaccaagaaagcaaaaaagaaagttatgatactataaaagaacttgttgaagaatttagagaaaaaaataatttttcaagatgccctgaacttttagaacaaagacacagcggtggaacgacttgtcttgaattaataggaatagcagcagacatggttgctgaaaaaatgggtcttgaataaaggagaagaaatgaacgctttaaaagataaagtaataatcgtaacaggagcaacaggcggaataggaagtgttatagtaagagaaatggtaaataacggtgcgaaggttctgctttgtgatataaacgaagaagctcttgtaaaactaagtgatgaacttggggaaaatgtaaaatattatgtaggggatttatgcgataaaaaggtatgtgaaagtatagcagcatactgtaaaaaagaatttggaaagcttgatacattaataaacagcgcaggagttgcattgagaaaacctcttttagaagttacaaaagaagagtttatgaagttatacgaaatcaacgtatattcaaatcttgcaatgacacaggcctgttatgaaatgttaaaagaatcagaaaatgccgatataatttcaatagtttcatcttcaggcatttatcctcattatcatcaaggtgcgtactgctcaacaaaatttgctcaaaaagctttaaacggagttttaaatatagagttatttgaagatgacatacgagtacataacttatatccttctgccgttgaaacaccaatggcaaaaattgcaagaggggatttaaaagaaaatatgtcttgtaaaccagaagaaattgcagaaattattacttttgtattatcacacagaaacaattctgttcttgacgatatagttataagacgttatacaaaacgtccggatgaaatgtaaaaaggtatgtattaaaaatggaagagtttgataaaaaagcaatagaatttggtgctgtaacggcaaaaatgattgacccaaaaacagtggtaactgctccatggactttaaataaatgtaaatacggttgtaagaattataataaaagacaatgctgtcctccaattgcaccaacatataaagaaacaagagaacttttagaagtttataaagatgttttgcttatacaatgtttggatccatacgatgtaaacaaagtaataagaaaaatgcttgattatcttggtaaaaacggatattataaagcattgggatttggtgcgaaaaaatgcgaaatatgcagggatgaatataacgaagaatgtacttttccaaattgtaagcatgcagataaagtaataccgcaaatggacggaagcggtatagatgttatacaaacggtgattaacaacggatacgaagaacatggcgtaaaaggatggggaagaaaagacggttttaaagttcttcctcgtgaagatggaggaaaggactggagtgaatccaaaataaacttctatggtttaataatgattgaataaaaaaggaggataccctccttttttatatattataaatatgatattatacaatatattttaatattaaataaaaaggatatataaattatggaacaattaattaaaaaagcagttgagtttggctcactaaatgcaaaaattaaagatacaaactcagtggtaattctttatgatgcaaaagaaaaatgcaaagaggggtgtcctttttatgataaaaagcaaggctgtccgccctcttctcctcaatataaggaaatagaaaatatattaaaagaatataaaaaatgtatgcttattcagtgtgaaaatatggataaagttgataatgttcttagggaaataaaaaaatacttaaaggaagaagataaagagtgctttatttttggagctaaggtatgtaatgtatgtgaagaattttataatgaaaaatgcacttatccggattgtaaacataaaggagaggttatacctcaaatgtcgggatgtggaatagatgttttaaaaacagctttaaacatggggtatagtgaaaatgattttgttatacaaaaaaacgattataaaaatgaagatataaaattttatggaatggtcgtattttaaaagaggcttagcctattttttattttaaattaagttgtaaaaaaaatttaatcgtatataataagcatagtaaaacatatggggagaataaaatgtattatacatatatgttaagatgtgaagataattcaatctatacgggtattacaacagatgtaaaaagaagaatgaaagagcattttgaaagaggagaaaaatgtgccaagtatactctaaaacatcatgcaaaaaaactggaagccgtatgggaaagtgaaaacagagttctttcttctaaacttgaatacagaataaaaagactaagtaaaatagaaaaagaaaatttaatcaaaaccccgaataagtttaacatatattttaaagatacattaaccatagatgaatataaatatatagatataaaaaatttagataaagagaggaaaaaataatgaaatttgtaacatggaatgtaaacgggcttagagcttgtgtaaataaaggatttatggacttttttaatgaaattgatgcagatatctttgcagtacaggaaacaaaacttcaagaaggacaaattgaacttgaaatggaaaaccaccatgattactgggactatgctgaaaagaaagggtattccgggactgcgtgctttgctaaaaatgaacctataagcgtaaaatacggtcttgatgatgaaaaattttcaaaagagggaagagttgtaactcttgaatatgataatttctattttgtaaatgtatatactccaaattcacaaaacgaattaaaaagacttgattacagaatggaatgggaagattattttacagattatttatgcgaacttgataagaaaaaacctgttattttatgtggagacttaaatgttgcccatactgaaattgaccttaaaaaccctaaaacaaataagaaaaatgcaggatttacaattgaagaaagagataaaatgacagctttactatctaaaggttttgttgattcatacagatacctttatcctgacactacgggagtatatacatggtggtcatatcgttttaatgcaagaaagaataatgccggatggagaattgactactttatagtaagcgatagaataaaagataaaataaatgacgtaaaaatatattctgacgtaatgggttctgaccattgtcctgttttaattgatattgatttataaatggaagtaaaaaatattacaagagatgatataaataaacttgctaatattttaactaaaaacgagataaaagaacttacctataaccttaaaaatgaagataataatttacgttataattcatttttgatattaagacaaagaagcaaaataaaagaagatgtgtattgctattttgatgtgtttaaagaaatgctttatagtaaaaatctatatcataaacatattgcaatttaccttattgcgcaaaacgcaaaatattcaaagaaatataaggataataaatttagttttcttctaaaaggatacctaaattgtatagatattaaaaactatatcctttcaaggcacactatccaaagcattatttatttttaaatatctatatcaatcaatatctatatatttttctattttgtcttttatattttctaaagtatcttccatataagaaatttgcttttctttttttgaataaacatctcttgttatcgcatctttatcatataaaatttccaaatcatcatcgattaagtcaagtctatcttctaaattttttacatcatcttttaatttagcatattcatttttataagatacattcaatttattttttagcttttctatttcattctttaaaatatcaatttgatttatattttccattctttctttgtcgttatcacttcttattaaagtatcattattatttacgtcattattgctatttgatagagataatgagcaggcagacaatgaacaaataaacaaacaaattaaaattgaataaaatactttctttaacatcgtttcacctcgttaaatatttttaacctaatataattttttattcaaaaaaagagaggtttccctctcttaatcatctattccaaaaatcagttcaattctatcttcgtaattatcaagtgtatcatccagcctatcaagtttcttttcaaaattcctgtaatcactttgacttaatgaaccattttcatacatcatttccaaatcatcatcataaatatcaattttattttcaacttcctttattttagacgaaatacttgaaaacttttcaatatcatcttgtctgctgtctcctgcttttgcattattaacaacatcttccaattcattaacttctttttcataagaagaaataactttatttatttcatctaaatctgcacttgatttcgtattttctgttgtttgattatctgttgtagaattagatgttatactttgtgaatctggattttgcccatcacctaaatttatatttatactacatcctacaaataatgctaaagaaacagttattactaaaaccaataaccccctttttttcattctaccctctccttataattaataaagtggaaatctgtcagttaagttttttactccttctctgatataatcagctttattgtcaaaatcagtagctgctaaataaataaattctgcaatttctttcatttcctcttctttaaatcctcttgaagtaacggcaggagtacctattctaacaccactcgtaacaaaaggactctctggatcattaggaattgtattcttattaacagttatataaacatcatcaagtctattttgaagctctttacctgttactcctacttttcttaaatcagcaagcattaaatggttatctgttcctcctgaaaccaaatcaatacctcttttaataagttcatcagctaaaacagatgcattttttacaacttgttttgcatattctttaaattcaggtttcaaagcttctccaaaacagatagcttttgaagctattacatgcatcaatggaccaccttgagtacctgggaaaattgccttatttagttttttaataagctcatcatcatttgttaaaataacaccgcctcttggacctcttaatgttttatgtgtagttgttgttacaacatgcgcatattctacaggattcatatggcatccccctgcaacaagtcctgcaatatgagccatatctacaaataaataagctcctacttcatcagctatttctctaaacaaatcaaatctaatttctcttgggtaagcacttgcacctgcaataatcattttaggtttttctttttttgcagtatcccttacttcatcataatcaatcatatgagttttatcatttactccatatgaaaccatattataaagaagacctgattgattaacaggtgaaccatgagttaaatgcccaccattatcaagactcatacccataactgtatcaccaacattacataaagcttgataaactgccatgttggcttgcgctcctgaatgaggttgaacatttgcatattttgccccaaaaagtttacatactctttctattgcaatttcttctgttttatctacacattcacatcctccataatatcttttaccgggatatccttctgcgtacttatttgtaagaacggttcccattgcagccataactgcaggagaaactacattttcagaagcaataagttctatatttctgcattgtctttgatattcttcaagaatacttctgcctaattccttatcatattccattaaattttttatgtttttttctacattcattaaatccatcctcctaaagtatgtcattttaattttactaaatttattgaattttgcaaacactttttaattaataataatatacaaacgtttccttttgttttataaatctatatttataattattattcgtttaataaagtttatatattaaaattttatttatatataagtttatttttatatacataaaaaacacttttttaaaagtgttttaaattatatctattatatctcttgcaccacccgtaatgcattctccgccttctttagagacaataaaagtttcttcaacaccaacaatacctctattatcaacaccacattttggttcaacagccaaaaccatattttcttttaaaggttcattaaatccatttgcaataacaggatatccgtctaaaaacattccaacaccatgtcctaaaaaagatacttttctatctttatatcccataaagttttcttttaactcacttgaaatattactcattatctcagtataaatatcacttggcttatttcccggttttaaaagagaagaaactttatttaaaatttccatacattcatgatgaagttctctttctttatttgttactttacctttaaaattatacacttgagtcttatcagtttgatacccctcaaacataggagaagtatctacaaaaaccaaatctcctttttttaaggtataatctcctccaacaataggaataatagcatttaatccttgcatccctccaggtccatcatgatttgtattaacaagggcatttttaccaaaactaaactgtcccaaagcaacctcattataaggatctttaaatcttacaacaccttgtgaaccaagtttaattttttcattatataatattccttgaaattctttttcctttagaccttcttttaaaatattaggaacaacttcgttaaatgctttagaatgaatctgtccacattttctaataagattaagttcatattcactttttacgcttaataatttatcaagaactctatccacatcaaaaatattattcatatttaaatatttttttattctgtttaatacaagcattgtcatttgtgacatttctatatatacatctgataattcattaccaatatattttacaatatccttgtaagatctaattttatatacgtcatcaatagttgcttctgcttttgctctatcatagtctcttctaacaaacaaatatggctttcttgttttgttattaaaaattaaaagagcatcctgcattgtaccggtaaagtaatattgatggattctatttataataataacattatcccatttaccattttcatccatcatatttaaaaatttttctattctatttttgctttcttcttttggaagtaaattatacataatatacctatctttctatattttttattacccaaatttttctatattataactttaatatttatttaatgcaaacaataaaattaatataaatatttctattaacatagtataaaacagttaacaaaaaaggacttaaaagtcctttttataattttattgaaagaggttctaccgccctttgtaaaataccatttaagtatgcaagaagaattccataatttacgatttccaaaccttgattatttgtatagctaattctatgtttcatttctttttcatttaacatacatccaccacaatgaactaccaaagcatacttatcaagattttttggaaattctgttccgcttgaaaattcaaattttaaatctttatttgtaaatttctttaacaatttaggtatcttctcacttccgatatctccacattgtctatgatgagtgcaaccttcacttattaaaacaatatcgccgtctttaagctcttttacttttcttactccctttaataatatatcaatttcgcctttatatcttgcaaataatatagaaaaagaagtaagaggaatatctttcggagtatctaaatctactcttttaaatgcttgtgaatctgtaataacaagtttaggtttttctttcattaaagaaatagtatcctttaactcatcttctttacacattatagcaacagcacctttatccaaaatatctcttattgtttgttgttgaggaagaattaaccttccttttggggctgctttatcaataggaataactaaaattactttatctgacggattgattaaatcagacacaataactttttcactctctttaggagcaattttacctattaattcttttaactcattaatattttctttggttacagtgcttacataaatataattttcatcttctattttagtttcaatcaaatcagatttattcattacaaccaaatatggaatatttttatcttttatcaaagaaagaatttcttcatcttcactgcttagtcctaaagaactatctacaataagaagtgctatatctgttttgtttagcacttgatatgccttttcaatacgcttctttcctagcatcccttcatcgtcaagtccaggtgtatcaattattgttaccggacctaatggcaaaagttccattgatttactgacaggatccgttgttgttcctttaacatcagaaactattgcaagttcttgacctgtaattgcatttattatactggatttacccgcattccttcttccaaatatgcctatatgaattctatttgcctttggagtttcgttaagtcccattttctctcctatactctaaagtctctttgtccttttttaatattttccaagtttctctcaacaacttctctcattttgtcacttggaatttttttaatttctttttcaatcaatttataaccatcttctcttgtcttttcacttgcataatcttctaaatattcagcaagtgtcataattgcattaggttgacagcaatttgcaatttgtttgctttttacaagttgcataaatctatcccctgttcttccttctctgtaacaagcagtacagaaacttgggatataatccattcctataagccaatctacaacttcatcaagaggtctattatcactaagttcaaattgtgctgaattttcttcttcaggttcatcatctgcataaccgcctacacttgttttacttccaccacttatttgagaaataccaagattcaatactttttccctacattctttactttctcttgttgaaataatcattcctgtataaggaacagcaattctaagacaagctacaattttagcaaatacatcatcatcaattccattatcaaaatcatcagggtcaatatcatctgctcttctaagtcttggaacagaaatagtatgaggtcctacccctttatatgcttcaagatgttctgcatgcataagtatacccgcaaaatcatatctgtataagttaagtccgaataaaacaccaatacctacatcatcaattcctccatccattgccctatccattgcttccgtatgataagcataattatgctttggacctgtaggatgaagttgttcatatgcttctttgttatatgtttcttggaacaatatatatgttcctattcctgcttcttttaatttcctatagttttcaacggttgttgcagcaatatttacgttaactcttcttattgaaccgtttttatgttttattgaatatattgtttttatactttcaagtatgtattcgataggattatttacagggtcttcacctgattctatagcaagtcttttatgtcctaaatcttgaagagctataacttctctttttatttcttcttgtgttagtttttttctgcatatatgtttattcttataatgataaggacaatatgtacatccatttacacagtaatttgacaaatataaaggtgcaaaagtaacaattctgttaccataaaattcttcttttatttcctttgcaagtttaaatatttcttcatttttttcttcaatatcgcaatcaagcaaaacagtagcttctctatgactaagtccttttttctttcttgctttttctaaaatttcatcgattaacttttcgttatgtttattttcatcagcatattttaaagtttccataatttcattatcatttatgaattcttctgcttttggtgacataacatcatattttatacccataacatttctccttttcataaaatgttttatatcaataataatttaactacataaattattttaataactaaaattaattatctaataagatactatctcctctgtcaactacaactgtgtatcctattttattcatgctttttcttaaatgttccaaactttccgcagcctcatcacctgtatttgccttcccatcataaagcatatatttatttcttacttcttttggagataaatttggcattacaacatttgctcccgctaaaacccctttttctcttccttttttatctattgttgcaagagccgttgtagcaggaagtaaaacatgaggtaacataagccttattatcccaagtaaatataaagtcattttgaaacttccgttattcttatctttaaacggtgtatctttatgagcaataaaaggacctataccaaccatatgaggattaagctcttttaaaaacaataaatcatctgccaaattttcactggtttgatatggagaaccaaccataattccgcttccaacttgatagcctatttcttttaaatcaaacaaacatttttttctgttttttaacgacaagccacttggatgtagtttcatataatgttctttatttgcagtttcatgtcttaacaaatatctgtctgctcccgcatcaaaatactttttataactttcataacttttttcaccaattgataaagttatggcgcaatcattatatttttctctcagtgcagaaataatttcaaccattctttcatctgtaaaatatgggtcttccccaccttgcaaaacaaatgtcctaaatcctaatttatagccctcttttgcgcaaagaagaatatcctcttttgaaagcctgtaacgcattgcattcttatttgaacatcttattccacaataatagcaatcatttttacaataatttgtaaattctataagacctcttatgtatatatcctttttataatattcttctcttctttttcttgaaagttcaaaaagatatttactgttttcatcgttcatattatcaatcaagaatataaattcatctcttgataaaattttgtcattatataacttatttattatatctttcaataatacctccaataaaaaatcccatacctaaagcatgggattaaatacaaaataaaacatataaaaatatttattttctttacccttagaaaaacactttaggtttagatattatataaagcttatcatcagatttattcttttgacttgcatagtgattataccattttatatttttgattacaacttaaaatctaaccataaatatggtaaaataagaaaaaaataataaggaatagaaaatgaataaacaagaaatatacgaatatttggataagttaaacattaaatatgaaaaatacgaacacaaaagagcttatacaatagatgaaataaacgaactttcaatcccaaataaagaaaaaattgcaaaaaatcttttcttaagagatgataaaaagcttaattattatttagttacacttcctccaaatcaaaaagctgacttaaaaaaattaagaaaggaaataggaagcagaagacttagttttgcaatgggtaatgatgtagaagaaattcttaacgtatctaaaggaagtgttacgcctcttgctgttataaatgataaagaaaataaagtaatatctgtttttagcaaagatttaaaaaatgaaactataggtattcatccaatggaaaattctgcaagtatttttctatcttttgaagatataataaaagcaatagaaaaatatcaaaatagaattataatatgtaatattgaagaataaaaaagaagtacaaaagtacttcttttttattcttcactttcatctttttctataaatgttatttttccatcttttatttcagctatatctctaccttcaattatatgttccaaccttttatcttctttaatattaatatttaaaagaggaatttccataatactttcaacatcatatttttttcttgccaaataaaaaaacaattgaccaacaaaaaaacatatgagagcataaaaaattaaaataaacaataaaataggatgcgtatcattaaatattatattttttaaagcaaaaattattgaaataaatatacctgccgcttcaaatgaaaatccaattccaagaattaagcttatcatactctcctccttatataaatgacattatatcataaaaaatgacaatacatatattttatacaaaaaaataaaaaaaatactttacaaaaaggtaattacctgttattataaaattacaaaagataatgatgtttatttctcggaggtttaaaatgaaaaaagattttgatttcacaaacattaacagaatggtggatgtaagtacggttagaacagatatagtaatggacgaagttgatgaaatgatcgatactgttataaaatacaattgtatatgtgcatctccaatgccatgggttacaaaatatactattgataaattaaaagattatcctgatatcgttacaacaggggttgtaagtttcccaagcggtgctgcaacaactgcaaataaaataatagaagcaaaagaaaatattaaaatgggatgtcaagaattagacatggtaagtaacgtaagtgctttaaaatcaggtaaatatgattactttgttgatgatattaaagctgttgttgaagctgctgacggtgttccggtaaaagcaatcatcgaaatttgttacttaacagatgacgaaataaagaaagcaagtgaacttgcagtaaaagccggagttacatatgttaaaacaggaactggttggggaccaaaaccaacaacagttgatacaataaaaatcattaaagaaacaatcggtgatgatgcattaatcaaagctgcaggcggagtaaaagatttagatacagtaatagaaatgattgaagcaggctgtaacagatttggtcttggtgttagaacagcaggaacaattttagaagatgctaaaaaaagatttagtaaataaattataatattccttcttaataaaaaagggcattctatatgagtgtctttttttaatcatcattaaaatatttaatacaaacattattatgtcaaatattaaacaaacaaaaacacgagaataaaattctcgtgtttttttatttatttaataatgaatattttatataaatattttcattaaccctttaagtcaaagataccatgtttttcttcaacatataaaccaaatgcatcaagagcttttttaagttctggatattgttttacagtttcttcatcatctaagtgaccaccattcattacgatatcaataccttgtctgaatgctttaccaccggcaactgatccgtctggatgtccgataacagctccaccggctgcgattactacatctgtaccgaattttgtcataacttcttcaatgtgaccttgagttgttccaccgccaggcattgggaatgaacgtttaatgttatgaagtggtgccaaatgagtcatacaaatttgttggaatttatcttctatcattgggaatttaccataaggactaagtacgatacccatatcaaaaccagcaagtcttggaagtttagcttgaattaattcagctgataaaccataatcatgagatacatataatgaacctgttaggtcaggatggaataagaatggaacatcaaattccttaataatatctctacaagcatcaagacctaaagtccaacagttaagcattaaaccgttagcgcctgctttaatagctttttcagcatttctcttagcttgatcaggtgtatctgtaatattaaatgtaaagattgttttttcacctttttcatcatcagctctctttaaagcatccattacagcactaactctgtcttcgatttttgagtatcctgcatttgcaataagttcatcatctttgattaagtcaacaccgccaagagcaacttcataagcgatttttgctgttgtttcaggagtaagtccacagcaaggtttaatcatattatttacaagtggtctttcttttactccaagtaattctctaacaccttctacaccatattttggtccttcaaatgattctaaccagcattttgggaatgataaatctaaaagtttaagtttaccaccacctgagatattaccaactgcagctgtaagtaacattgcgaattgaactgagaagtttgcaattgggaaacctatttgaataacccatgctctttctttaacatcatcaggaatacaccaagcatgatttggaacttcataaataccacatactctggcaacgtgttctcttcttacttcaggtgtttcttccggtacaggtaaccatgttcctgttgattgttccactgctaaagcaaaggattgttttaaagcatttgttgtagtctttccttgataagcatatgtagcgataataaagttatctctatctatgttatctgataattcgaacattgttggatcgtaagtcatttttacttttgacataattttttatcctcctaaatctttctatgtctatagtatattattgctttttaaatctttcaatacagaaaatttttgcgttagaatgaaaatttttgcactaacaataatcattttatgtttatcattcttgaattatcttatttaatatttataattatattagaacataaaataaggagaatatatggatccacaaatttacagacaatctacatctctaatgatgaaaactacatttttatattatgaaaaaggactttcacaaagtaaaatatcaaaaaaacttaatatatcaatttccacagtatccagacttttaaataatgcaaaaaaggaaaaaatggtttcttttgttgtagatgaaaaagttttagaagtcgctgatttggaagaaattataagagaaaagtttaatctaaaagacgtaatcattgcaagatggatggaaaaaagatatgaacctgaaaaagatgatataaaaaaacttgttgcttttgaaggtgctcaatacattcaaagaataataaaagataatgatattttaggtatcacatttggaagaacaatgtaccatatgataaactcttttaatccatgtaaaaaaactgacactcaatttgttacattacacggaagtttagataaaatacatagagattttaacgttgataccctaacagaaagaatggcaatgtcttttggaggtaaaaactacacaataaaagcaccgggacacgctaacacagaatacgaagcaaaaatgcttataaatagaatggataatcatgaagtatttgagaaatttaaaaatgtaaatattgttgtatctggggtaggttctttttaccctgacatgacatcgtatttatgtaatgaaaactatttttcacaaaaacaacttgaagaattaaaagaacaaaaagtttatgctgatgttggtcttcgccttataaacgaacaaggtgaagaatgcaatacatctctaaaaaacagaacaataggaatatcttatgaagattttaaaaatattccaacaaaaattattattgtaagcggagaacataaaaaatatagtgttaaggccgccgttaaaggtggacttgccgatgtattaataattgattatgatttagcaaaaagtttaattaatatttaaaaaagactgtaaaacagtcttttttatttaaacatttttactatttcattcatatgtgcgtttgcttccttatatccaagttcataaacttgttttatataattttcatccatttttaattttgtatcttccaaatagggatttagaatcaaatcagatgcttggataccagggataagacttctatctgccataatatcaatggttgaaaaaatcatatcaaaatattttgtgctgtctgtccctattttggaatatgcctttaaattaatacttaaaactttatctgcacctttatcttttaaaatatcagccggcatattatttaatacaagtccatcaactaaatgatatttgtttgtaattactggagtaaaaactcccggaattgcactgcttgcccttatggctgttgcaagtcttcctttatccataataataagctttccactttttaaatcaacacttacagcataaaaaggaatttttgtttcattaaataatttatcccctgcaatccccataaaaaatttctctatattttcagaatcaatggcaggggaaaaatttaaacctttaaatgaatttaagaattcttttggagacgcaaaacttaatttactttttaaacttttataattaattatatctcttacttccatgctcaaagagtagtcaagcatctcatcggcacttaccccaagagaatacaaagcacctactatgcttccggcactgtttccgcttgccatatcaaactttattccgttttcttccaatgccttaattacacctatatgagcaaaaccttttactcctccgccgctaaaacatattcctttttttttcttttttataaagctaaacatgaccaattcacctctaactatattatactaaattatttttattagtaaataaatcccttgacacttaataataatttaattaaaatataatattataaatgggctattataactcagttggtagagtaactcattcgtaatgagtaggtcgtcggttcgagtccgactaatagctccattttttttggtcttatattactcaaaattttttattaactaataaagtctataaatttctatataatcaatattaattttcttttctttacatttcaatcttttatatattatactatttatattataaaacatttataacataaaaatttttaatcatactcaaaattcaggagaaaaaaatggatttaatttgttttggagacagtttaacaaatggtgaaataggttgttcatataggagttatttagataaaaatcacaaaacaatcaataaaggtattgatggtgatacaacagaaggaatgtatttaagattaaaaaatttcttacaaaaagataatatatatgaatactacataatttttataggaataaatgacgttttattttctttcagtaatgaacaacaatttacatcaatatacgaaaaaatagttaaattactaaaagaaaataataaaaaagttatatttacttttagcaataattaatctatttaagactaaagaataaacttattttttattagatttattaggtgtatataaaataaatatattaaaaaataaacttattatttgtaaatatagtttttaaaatttggttttataaaaatctattattaaaaattaagacattgaaggaaaggaggaaacggaaatgttttataataaatcaaaaaagataatagcttatattataacttttatgataatttcttttttactgttttcttctttatttataattaaaaatgttaatcacgactgtgtgggggacgactgtccgatatgtaattttattcatgatattgaacatgttttaaaaaatctagacagcgggaaagctgtatggagtttttatttatttaaaattttattttatttcaatttaataacatttatttcttattctgttcttaagagaactttgattttagaaaaggtcagactcaataattaaaataaacctttagtatgggtaatcttttataggttaaattattacccttttatttttatgcaaaaaattaaaaaaagagaggtttattatgaaaaaattaatatgtggtttaatgattgtggttttatctttaagctgttttttcggctgcggtacaaacaaaggtaaaaaagaagaaggaaaaataaaaattgttacgacaatttttccggaatacgactgggttatgaatgtgcttggtgacaaaaaagacaatgcagatgttactttgcttcttgataacggagtggatttacatagttatcagcctactgccgatgatattttaaaaatttcaaactgtgatttatttatatacgtaggcggagagtctgacgactgggttcaagatgttttgaaaaaagcagacaataaaaacatgaaagttattaatcttcttgaagttttgtcagacaatgtaaaagaagaagagattgttgaaggaatggaaagtgaagaagaacatgaacatgataaagacaatgaaaaagagaaagcacaggttgaaaataataaggaagaggaaaaagaaatagatgaacacgtttggctttctttaaacagctctaaaattatagtaaataaaatcggaagcacattaatggaaatagacaaatcaaacaaagacacttttaagaaaaacacacaagattatataaaaaaattagacaagctcaatgtaaaatacaaagaaacaataaaaaaagcaaataaaaagactcttatatttgcagaccgtttcccatttagatatctgcttgatgattacgggctaaaatattatgcagcatttgcaggatgcagtgcagaaactgaagcaagttttgaaacggttagttttctatcaaagaaaacagatgaactatcactaaactatattataaccatagaaggttctgatggaaaacttgcaaaaaccattatttcaaacactaaaagtaagaatcaaaaggttttgaccatggattcaatgcagtctactacttcaaaggatattaagtcaggaaagacttatattgatacaatggaaaaaaatcttaaggtgattgaagaagccgtaaaataaggaggtaaatatgtcttttataaccataaaaaatctttcaattggatataatacaacccccataagagaaaatataaattttaatatagaaaagggagattatctttgtattttcggagaaaacggaagtggaaagacgactttattaaagacacttttaggtcttaaaaatccaataaaaggagatattatctttggggataatctaaataggaatgaaataggttatcttcctcagcttgatgaaatacaaaaggatttcccggcatctgtttgggaagttgtactgtccgggtgtcagtcaaagcttggctttagccctttctattctaaagaaaacaagaaaacggcagaaaagaacatggagaaaatgggaataaaaaatttaaaaaggtgttgttttagcgagctttcaggagggcagagacagagggctttatttgcaagggctctttgcgccgcagagaatgtgctttttctagatgaacctgtaacgggacttgatcagggagcctgcagggatatgtatgaaatgatttcaatgttaaataaagaaggccttaccatagtgagtatatctcatgatattaaaaattcaattaaatactgcagtaaggttttatatcttggtaaaaaaagtttatttttatctaaggatgattatgttgatttagtatataagagtaaaacgcttaaagatggaggggtaaggaaatgattgaaaagttgatattttaccttgattatccatttgttgtttatgcgttaatagtgggggtgcttattgctctttgctcttctcttttgggagtcattcttgtattaaaaagattttcttttataggtgatggactttcccatgtagctttttcccttataactgtggcttctgttttaaatcttactaacgatatgcttcttgttcttccgtgtacaataatatgtgctgtattcttactaaagtccggaaagaacactaaggtgaaaggggatgcaatgatagcaatgctttctgtttcttctttagcatttggatatttaataatgaatgtattttctacatcttcaaatttaagcggagacgtctgtacaactctttttggttcaacatcaatacttactttatcacattatgatgttttaatgtgtatagcattatcggtagttgtggtattgtttttcattttattctacaacaagatatttgcggttacttttgatgaggatttttcaaaggctgtgggagtaaatgcaaacagatataatttaatgatagcaataataattgcagtaataatagttcttgcaatgaatcttgtaggttcgcttttaatatctgctctcattattttccctgcactttgtgcaatgaggttatttaaaagttttaaagccgttagtgtatgttccgcttttatttctgtattttgtgcattgtttgggataataatatccatccttgcaggcacacccgtaggttcaagtattgtagcaataaatgcagttatgtttatagcctgttattttataggaatggtaagaggaggtatttaagatgaaaaaagcagttgtaatgttaatgtgtattattatatcaatatcttttatttcttgttcgtcagaagaagctgaaaatcaaagcacacctcaaaacgatttacaaagcactgataaagaaaatacaataaatgaaaatactgaaaaagaaagttccgataataaaaaatcggacaaaaaggaaattgtagatttaactaaactttcctctaccatggtttattccgaagtatacaatataatggtaaatcctgacgattatgtaggaaagataataaagatgaaaggaacatttaatgtttatcacgacgagaaaaaggacaagaattattattcctgtataattcaggatgcaacggcgtgttgtgcgcagggaatagagtttaatttaaaaggtgattatgaatatccaaaggattatcctaaagaaggctctgaaattacggttatgggtgaatttatccgatatagtgaaggaaaacacgtttactgtactttgaaagatgcaaaattattataagattatatatggttaatttaagactaaaaggacggttttatgccgttctttttttatgtgggaaatttttccctgtcttttttgtgttttgatattttattgtcaaaattttggatttattgtaaaatagaaggtaagaattctgaactaatagaagtaaatagttagattaatataaattagaggggtaagatatgattactggtgaaataaaaaataaaatagacggtttatgggatgtgtttttttctggcggacttacaaatccaatggatgtaattgagcagatgacatatttaatgtttattcatgatttagacgaagcggacaacaggaagaaaaaagaaagcataatgcttaatattccttatgagaccgtatttaaagagattgttgttaatatagatggaagagaaataaaggggcaggagcttaaatggagcatattcagggattaccctgcagaaaagatgtatgatgttgtggggaattatgtattcccatttattaaaactcttgacggtaacaaagaaagtgcgtattcaaagtatatgggggatgcgatttttaaagttccaacacctttagttcttgaaaaaattgttacgggaatggatgaaatttatacaaattcaaatagggtacatgatttggattttagaggggatatttatgaatatcttctttcaaagattgccactgcgggagtaaacggacagtttagaactccaagacatattattaagatgatggttgaacttatgaaaccgaaggctgatgatgttatatgtgaccctgcctgcggtacttcgggatttttggtaagtgcgggagagtggataaaggaaaacagaaaagaagaagtgttctttaataaagaaaaaagagaacattatatgacaaagatgtttacaggttacgatatggacaggactatgcttagaatcggagccatgaacatgatgacccacggggttgaaagccctaacattgaatataaagacagtttatcagaccaaaacgaagataaggataaatatactttaatattggcaaatccaccttttaaaggaagccttgactatgacatagtatcagcggatttgctaaaagtatgcaaaacaaaaaagacagaacttttattccttgcgttatttttaagaatgcttaaaatcggcggaaggtgtgcttgtattgttcctgatggggtattattcggttcttcaaatgctcataaacaggtaagaaaggcgatagtcgaagaaaacagactggaagccgttatttccatgccttcgggggtatttaaaccttatgcgggagtatccactgcgattttgattttcacaaaaacaggaaacggcggaactgatgatgtatggttttacgatatgaaagccgacggtttcagccttgacgataagagaagcgaagtaaaggaaaatgatatccctgatataatagaaagatttaacaacttagataaagaaaaagacagaaagagaaccgagcagtcattctttgtaaataaagaagagattgcggaaaacgactatgatttatcaataaacaaatataaagaaatcgaatatatccctgttgaatatccacctacaagggaaattatcggaaacataaacacccttcaaagagaaattgacgaagacatgaacaagcttatagatatgcttggggagggggagtaaggtgaaggttaagttaggagatattgcaacatatataaatggttatgcatttaaaccgagtgattggaaaacacaaggtattccaataattagaatacaagacttaacaggaaatagttatcaaacaaattattatgacggagaaagtattgataaaaaatatgaagttaatgaaggagatgttttaatttcatggtctgcaagtttaggtgtatatatatggaaaggtgaaaaagcattattaaatcagcatatatttaaagttgtttttgacaaaatcgatatagataaaatgtattatatatatgcattaaaatttagtttaatgaaaatgaaatcttttatgcatggggcaaccatgaagcatattgtaaagaaagattttgataacataacaataccttttccttcattagaagaacaaagtaaaatagcaggtattttgcaattagtagaaggaataatcgaaaaaagaaaaaaacagcttgaagatttggacgagcttgttaaggctagatttgttgagatgtttggggatccggtggagaaccctatggggtgggaaattggcaagataagagatattgttagtgatgttcgatatggaacaagtcgtcctgctgttgagaatggtcaatatccttatttaagaatgaataatattacatataatggagaattggatttatctgatataaaaaaaatagatattcctgaaaatgaattggaaaaatgtacggttagatttggtgatgttctttttaataggactaatagtcgagaacttgttggaaaaacatgtgtatataatcgaaatgaattaatggttcttgctggtttcataataagagtaagagttaatgaaagaatgttacctgaatttttatcttcatttttaaattctgatttttcaaagaaaatgttattaaatatgtgtaaaactgctattggacaagcaaatataaatgcacaagaaatgcaaaatattaatatatatataccacctataaatgttcaagaaacgtttgtcaattttaaacttgaagttgataatattaaagagaagatacaaaaatcacttgatgaaacgcaggtgttgtttgatagtctaatgcaaaaatatttttaggggttttacccctaaaaccccacgacttttttattcgcctaaaaaagtcgaaaaaaatggcgccactgggcgtggaggtttagagtttcgctctaaagagcgaccatatttttgccaaagcccaaaaatatgggaaaaacgcttttactcatgcgccgtaaaggcttataacgtggtcggattttctaaaaatctctgcccgagatttttgaaacgaccactaccgctaccccggggtgggggaatgatttgaggtgatgatatggaagaagataaaaggttagaagttattgatttaaatggtgttaaaaatactaaatataatacaaaattaatacctaatcagagtgcaaatacgttatttaattttatggatgactttatatatttagaagaaatgattgaagaaaagtgtatttatccaagatattcaaaagaagatttttcttttttaaatattccaaatattgaaaccttttatattgcaatgaaatgtttttgtgatattcatttacatatggtttctaaacataaagaagagtttggtgattatgctatcggattaactaaagaatggggagtaaggaatggattacaacctattatatattgtaataaaaattcatcatatgtaaaatcaataaaaatatcatatgatagttttaatagatttaaagatgaatttagagaagatagaaataattcaaaaattataaatgatatggcagaaagttttaatcagtctttaaaacttttaaaacctatgtttggtaaatctaataaaacaaaaaaagagaaattttttactgatgaacaagaatggagatatattcccaacattcaaaatgatttacatttaaaagaagtattttcatataatttttttcaagagaaagataaatttgaacgttataataaaaagttaaaagaaaaaaaatatgcgattaaatttgagtataatgatgttagatatattattgtagaaagtgaaactcataaaaatactttgattaatagtattgttaatattaaagatataagcgataaagaaaaatataatttgcttacaaaaattttagtttgggacgaatgtaaaggagatttttaatggcaaacttttttgaaaattttggtgatgaaagaaattgtaaagaaattctaccggaagttttagaaatgatttctgcaaagtataatggtgcttttttttacgagcgagatgagaaaagtaaggcttattttttgaatttaaataaagataaaaatataaactttgagataaagaatttggaaataatcggtttggatgaaataaaaaaaaattgtgggaaagaagatttaacatttgaagaattactaaattattcaacaaatgcaatggaatatatagaaataaaattaaataaggattttccgattacaataaatggagtaaatttagatgaaagagaccttattctttcggaaaatactgtttctaaaagaaatactaaattatacataaaatcaggagatgaatctaaggaaatacctttaaaaattactgaaacggaaggtggaaatgtttatgtttttacagcttatcaaaaaccatgtaagtcgttatataaaagaaaatattcgacaaaagatgataaatggcttattattgatattgatatagatagaaaaaaggggaaaatacattttaaatatacacttaataataaaattataaaaactgcagaggattatttatctgctttaaaatttgtaaaaaatgctgataaaaatactattgattttttagattttaaatataatctttctggagataaaaatattttgcctgatgatagccttattgaaatatgggaaaatattgttgcattagaaaaagaacttggtttcaaatttgagcttggagaagataagacattaagtgacaaagaaattatacaaataaagaaattatatagaactttagtagaaaagaaaccttttaaatgggatgagaaattgaataatttaagttttgatattttagatgaaagtaaaaaaataattaaagactttagagataaaaaaggtaaatttgctttgtttggtgatggtaaggatgatgatgttgaaatagctttttcaaagtctgtggaattatatcaaattagtgcgttttttaatttaaaatatgattatgatgaaacagacaaaaagaataaaaaatatgtgatttattttaaaaatgataacaatgatgaaagatataaaagtgtaatgttctttaaaacagaagaagagatgaataaatttaaaagtgataacaattttttaaatattttagcaaaagcagaagaattaaaagggatacaaaagagagaatcttaatattgttcataggtttggggtagcttttctgtccgtaaaatgcgggtagcattttgcgagacattgaaaagcgtttaagccttcacggcgtttgagagaaagcctttttcccatatttttgggctttggcaaaaatatggtcgggttgttaagggttgaaaacccttaaatatggagagcattttatgagacattgaaaagcgtttaaggctcttcgcctagaagcgcccttttattcgacttttttaggcgagtaaaaaagtcgtggggtgtaaggggcaaagccccttaaagaaaagaaatatttaaagaaaaggttgttaagggcatagcccttaaataataggggtataaggggcaaagccccttaagaaaggttcttaagggaactcccttaagaaaggaaaggagaaagttatgaccaactttgattttcttttaaaagagaaaaagtttgaaagttttgcaaatattgccgtatcggcagaaaagatatttaatatagacatggaagcctgcgccataaactgcagaaaggctatggaaatagcaattaagtggatttacagtgttgacaggatactcgataaaccatacagggataatctgcagactcttatgaacagcgaagagtttagggatattatagacagcgatttatataagagaatggactttataagaatagtaggcaataacgctgctcatgaaaacaaaaaggtaagcgaggaacaggttaaactgtcccttgaaaacctgtttgtatttatggactttgtggcttactgttatgcagacagctacgaagagagaaaatatgacccttcacttcttgaaagaaaagaagaagagaaggtaaaaaaagaatttgcagacatagacttagaaaaacttttaaaagaaaacgaagaattaaggaaacagctttcaatacaaggagaagaaaagagagaaacatataccccaaaatctctggacttatcggaatttaagactaggaaaatatatattgataccatgcttagcgatgtgggctgggttaagggaaaagactggatagacgaagttgaagttaagggaatgcctaacaaaggcggggtaggatatatagattatgtattatatgatgatgcaaacgtgcctttggcgattatagaagcgaagaaactttgtaaagaaccttctgcgggcagacaacaggctaaactttatgcggatattttacaaaaagagtatggaagaagaccggttgtatttttaacaaacggatttaaaacatatatagacgacggagaatatcaagaaagagaagtttcctttatatactcaaagagagatttggaaaagctctttaacttaaaacttacaaaggaaagtttgaaatatataaaaatagataagaacattgcgggaagatattatcaagaaggagcggtaaaagccgtatgcgatgcatttgataagaagagaagaaaggctttacttgtaatggctacggggtctggaaagacaagaaccgtaatatctttatgcgatgtgcttttaagaaaaggctgggttaaaaatatattatttttggcagaccgtaattctcttgtaacccaggcaaagagaagttttgtaaatctgcttcctaatctttctgttaccaacttatgcgaggataagggaaattattctgcacactgtgtattctcaacttatcaaaccatgataaacgtaatagacagcgtaagggatgaaaaggggaggatgttcagctgcggacattttgaccttgtgatatgcgacgaggcacacaggtctatttataataaatacaaagaaatatttgaatactttgatgctcctttggttgggcttacggctacgcctaaggatgaagtagggaaaaacacatacgatatattcggacttgaaaacggagttccgacttatgggtatgaacttggacaggctgtaaaagacggatatttggtggattatataaccattgaaacgaagcttaagtttatggaagagggaataagctacaatgaattagacgaagaggaaagggaagagtatgaaaacacctttaaaaacgaagacggaaccatacctctacatatagattcatcaaagttaaattcttttgtatttaacgaggacaccataaagcaggtattaaacaccttaatgacagatggattaaaaatagattacggcgaaaagataggcaagagcataatctttgcaaaaaatcacaaacacgcagaaaagatacttgaagtatttaacaaggaatatccacacttaaaaggatatgcttctgttatagataattataccaattacgcacaaagtgccattgatgaatttgccactttaagtaagcttcctatgattgcaatttccgttgatatgctggatacggggattgatgtgcctgaaatattaaaccttgtgtttttcaaaaaagtaatgagcaaggcgaagttctggcagatgataggaagaggaacaagactttgcgaagggcttattgacggagaggataagaagaacttttacatatttgatttttgctctaactttgaattcttttccatgggaggagaaaacaaagaagcaggggaagttaaaacccttcaaagcagtatatttaatcttgaatttaatctttgttataaacttcaagacagcgcttatcaaaatgataaactacgagattttagagataaattggttgatgatttaataaggaaagtaggaagacttaacaaagataattttgcggttagaaagcatattcaaattgtggaaaaatatcttattaaagaaagttacaatgtaatagattttagggagcttgaggaagtaaaagaagaactttcacctttgatactgcctgatgaggacgacccaagggcggtaaggtttgacgcacttatttatatggttgaactttcaatacttgaaggaaataaatacaccagaggaataagcgatatagaaaaaagggcaagtgccttaaaaaaggttactacaataccggaagttatggataacatagacataataaataaggcatcagacagagaaagactaaacaatatggacattgaagggttagaggaaataaggaaagctcttcgtgatttgatgaaatatattccaaagagtaaaaagaacatttacagcactcattttgacgatgatatactttctaaacaagtcaatgcttcatcctttagcgatgacgggcttgaaaactacaaagaaaaagcagagttttacataaggaaccatatggacgaagaggtaataaagaagataaagaacaatagacctcttggcagtgaagacatgaaaaagcttgaagacatactttggaacaaaataggttcaaaagctgattatatgggagagtttggaggtaaacctcttggggaatttgtaaggcagattgtagggcttgacatgaacgccgcaaaagaagcattttcaggatacatatcaagaaataatctaaacagcaatcagatatattttgtaaaccaggttatagagtacattgtaaaaaacggggttatgaaagatttttccgtaatgacacaatcgccttttaacgatgcgggaagcgttgcggatttatttgaaagtgatatgactgtttggaattcacttcttggggtgattagggaaattaatgctaatgccggggtgtaggtgatatatggaggattgagataaaatgagtttagataaaaagactatagaaacattgtctgttaatgcagtagaagaaagtgttgttacatctggtttattagatagttatattaacgaaaatgataaagagccttcatgggatggggctgtttatatatataaatgtaaaaagaaaacaaaagaaaatttgagaggaagaatgcctgttcaagtaaaagggaaagagtgtaatgatcactcgaaaaaaactatttcgttttctataccaacagtggatttaaaaaattatcttaatgatggaggatgtatgttttttgttgtatatattggtaataatgggcttacaaaaaaaatatattatgatgaacttacaccgataaaattaagacaaatattatctgaatcaaaaaaacaaaaaaataaaagtttgcatttaaaagaatttccggtagataataatgaaaaaaatacagtttttttaaattgtttacaaaactgcgaaaagcaaaaaagttttaaagattgtgagttgtttagtttagatgaattaactcaaaaaaatgtgttagaagatctttttattcctgttgaatttgctggaaaatttaatttacagacatttttattaaaaaatgatttttatatttatgctaagattaaagggagttcagttctccatcccattaatataattcttaaaaatatacatactcatcagataatagatgggttgattacaattgatgataaagtgttttacaaaaattttgaagtcgaaaaaactgccattgaaaaaattattcatattggagaaagcttttctattcattttattgaaaacagtaatgaagttaattttagatataacaactctaaaaaattgagtgtattagtacatgatcttaatttttttcttacatatattgaaaaaggatattttaatatagataatgtaagaattccatttaattgtataaaaaatcttttaagaaaaggtacattaaggaaattaagagattgtgaaacagaaggaggaaaagaaaacttaatatagtaaaaaaaaagcaataaaataagaatagattgctgataagcaagaggcgagtaaacctctgaaatttaaaatagataaaaataataaataaaaaagaagaaaatgaaacgttaagggtaaactatattaaggaaaaatagaacaggaagtttatataagcaattgggaagtaagtttaaataataaaaaaagaaaaataaaaaaaaagataaaaaattaaactgaagatattgcaaaaaaatgatagtactgtgaaaccaaattctgagtcacaagaatcgagatactaggtaaaactagtaaaagaaggagagtctgaaaagactctctttctttatttatattttatgttaaaatataaataataaatatttaggaggcaaaaatgaaagctatcgtattagaagataaagaaaaagttgtttataaagatgttccaaaacctgaatgcacaaaagatggaatactcttaaaaattgacgctgttggactttgcggttcagacgtaagaacatattcgtcaggtgtaaatggcttggattttccttttattttaggacacgaaaatataggtataatcgaagaaataggtgaagaagtaaaaggatatagtgttggagaaagagtaattgtaaatcctgttataccttgtggtaactgttattactgcgaaaaaggtatgcaaaatttatgtgaaacaagacttacatatgggcatcatttgcatggtggttttgctgaatatatgttaattccgggtattggggtacaacgtggacaaattctaaaaatacctgaaggcgtaaaaagtgaagatatggttgtagttgaactattgtcaagcgttgtaaattctcaagatttaattaatgtaactcttggagatactgttgtaataattggggcaggtccacttggatgtttacatagtgaaattgcaaggcttagaggcgctaaaaatattataatggcaaatagaagtgaagcaagacttgaaaaaagtaaagctttcagcggaacacattttgtaaatacatctaaagagaacttaaaagaagtagtaatggatattactgatggaagaggagcagatgtagtaataaattcaactcctgcaacaaaacctattgaagaaggtatacatttactaagaaaacaaggtaaattattaatttttggtggtcttccaaaagacaatccaaatgtaagtttagatggtaatttgcttcattacagtgaagttcaagttattggaggattttcaacaactcctgatagttttagaaaagcctttgacgttgttgcaaacggaatgataaatgcaaatttagtttctcatattttacctttaaaagatatggaaaaaggtgtaaaaatgttaaaaagcggagaagccttaaaagtagttttaaaaccataaaagacagcaatttgctgtcttttttattgtaatacatcgcttgtaacagaataaacggaatctgaaaaggcataagtaagtgcatcagaaactacttttgccatttcataaatattatttaaacgcagcgttgtaagagaatttattgcatctttttcattgttgcttacaactaaagtaagggacgtatctcctgttttgggtaatattttccctgtagcttttccggggaatataccttcattaaataaaataatgtctcctacatttcctttttgtgaaatcattgagtcaataacgaaaatttctttaccaggatataaagcttcaatataagaaagggttttatttatgttaagggcatgaacaggatgtttgattgttccaaaaataggattatttaaaaaattataactttcaagcaagcttcctacaattggagcaaatgcatctccgatacatttatcagttcctataaaaagcaaaatacaatctttagatgttaattttatgatttcttctgcaagcaattttgcagcatttttttgtaaatagttaaatgttttttgcatattcattctccaaaaaaaatataccctaattatatataatagggtataagtaaaatgtagatatttgtttaaagttatttcatattttctagattattttttattgcggtaaacattctttcatctgcatttggtatttgcttttttaaatactttactaagtttttcatttcttctcgttttgtaaatccatcggcagggcattcactttttattataggaatattttcagttttaacagcatgaattacatcgttttctttagcatataaaagaggtctaagggaataaacacctgttctatcaagataagttacaggcttaaaagtgtgtattcttccttcgtaaaaaaggcttagtaaaaaagattctataaaatcatctctatggtgtccaaaagcaattttattactgccaagttttaacgccgtttcgtttaaagccgctcttttcatttttgagcataaagaacaaggatttttttcttttctttcatcgaatacaattttctttatatccgtatgaacaatttcaagagggacttgaatttcatcacaaaatgattcaagcttatcaagtttcatattatcaaatccaacatctatacaaattgcggtcagtttaaatttctcgggggaaaaatacatatatgtttttaaggcttttaaaaggagcatactgtcttttcctcctgatacagctacacatatatggtctccgtcatttatcatgttataatcttttactgcttttctgatacatcccagtgtttttctcatgttatattccttttctaaaaatatttatttatactttttacaattgcatttacaagtttgttttgatttttctcattttttaattgttctatttcatttttgttggaaatgaaaccacattcaattaatacgcttgggtagtttgtcattcttaatattctaaaattattatcttttactgcactatttttatttgcgagaagaggcgcaatataatcaagcctagaaagttcctcgtttaaaatattagcgaactttaaactttgttttgcctctttgcatagtgttatgtcttttactattacattacttcttcctgttgatgaaagtatatttattccatttgtataatatactgttgttataccgttattaatctcttctttaataaatgggtaagtttttccgttttcttcaacatatatatcattaaagtctaaattggctttaaaagatgaatagtaaattgtataaccgcttttattgtttttggtgcctgttgaatcatggtgtatgcttattagtaaatcaggcttaattttatttgcaattattgttctgtttgttaatgtgacttctttttcatctttgtagggctgtcttgtgaatttaacaatatagccttctttttttagtgcatttgcaagcttgattgtaacttggtcattaagcgtatattcatttgttttttcactgtctacaccaattgcacctttatcagccgaaagttttccaccgtgccccggatcaagcaatattacataattatttttgttttttatattaattgtaaaaagcagaataagtataaaaattaaaaaacataaaaataaatttttggatattttaattctcatatatttattctatattttaataaacccacaaaatgcaatattttgtgggttagtttacattttatcaattaagtctgcaatcttatcaaagtcatcttctgaaaacattaaatcaatttggtcttgttttgtaggtttaatgtttttatttgtttttttatcattatttatattattttgttttgatgaggttttagttgtttcgttcttatctaatgaagtttttatttttgagttgttttttgttatatttttgttttttaaaacatttgcttttttgttagatttatttgctttgtttttttcttttttggttgtttctatctttataacatcgttttcttcttttaagtttgagctgttaaataaaaactccataaattcatcattttctttttcttcttttgatgtatttagaagtgtactgttttttaaagcttcggataaatttttatctttattttttaattttttattatcttctgtttgtttttgtgattgcattgatttgctttttgcataaggatttactctttttcttttttgtcctatttttttatatgtttcttcaagtagttctttatcgcttagatgttttcttttctttacttgttccttagatgttttttgctctatttccttttgggtaatatcatacattttcatcattaaattatgttcttgtaagtcaactactttcgagcgttcatttaaggatgtatgaattgttttaatgttatctaaaactccatccaatatttcttgctgttgaagtctttgttttcttagttgttcctgtttttttatttcttgttcaattttgatcttttcttctttttctttctcaagtttttcaagttctttttgaatatttaattcttttaaagaaagcgtatgttcaaatgtttttaattgttcttctttttgttttaattgattttctttttcttttaattcttccaaagcttgctttgtttcttcttgttgttgctgctcttggtttttgatttctataagttcttttttcattttattaagtcttaattcttcactatagtcataaggatcatcaaaaacttgtacattttcttcttcttgaagttcttcttcgcttatgcttagtaatagagaacgagatattgtttcaacaataatatcaacggttaaagcaataagttgaagataggtagaaacgcctacttttagaataaatcgaactaaaataaaaacaatgatattagcgagagtaacacaagaaatttcaaataccatacctctcgtttcttctttatataaaccggcaagaaaataaataccaattttaattaaaattagaagaggtataaatttagggaaattaggatcaattgttaaatttgctttattaaaaattaaattggctacaatatatgtaatagccatgaaaaatatatcaataaaaactaaggatactgtcttaattgttttttctttattcaatataatcacctttttaaattgtttatacattataacataaatttatataataccaaaatgatatttaataaaatataaaaatatataatctttttatatataaaggtgattgagttgacaaaagttaaaaaaaaatattataataaaaaataaaaattgtgtactgttaggagatattatgttagatataaaaagaataagaaataatacagatgaagtaaacgaacttcttgcaagaagaggggattacagtgttaacgaagttttagaattagatacaaaaagaagagaattgttatctaaagccgaagaaggaaaggcaaaacaaaacaaagtgtcaaagcaaattcctatgatgaaaaaggaaggcaaagacgtaagcgaattattaaaagagatgaaagaactttcaagtgaagttaaagaatacaatgcacaaatcagtgaattggaagaaaaaataaattcacttattctttctattccaaatacaccaaacaaagatattgttataggtaaagatgaaaatagcaataaagaattaattaaggtcggtacaccaagaaaattcgattttaaagctaaagctcattgggatttaggtgttgatttaggattacttgattttgaaagagctgtaaaaatttctggagcaagattttcaatgtttacaggaatgggggctaaacttgaaagagcgttaattgcttttatgcttgatactcacacaatagataatgactatattgagatttctcctccatttatggtaaacagaacatcaatgacaggaacaggtcaacttccaaaatttgaagaagatgcatttaacattaaaaacaatgattattttttaattccaacagcagaagttcctgttacaaatatccatagaggcgaaattttaaaagaagaggaccttccaaaatactttactgcatatactccatgtttcagagccgaagctggaagtgcaggaagagatacaagaggtttaatcagaaatcaccaatttgataaagttgaacttgtaaaactttcaaaaccggaaaactcatatgaagaattggaagacttaactttagaagcaagaaaaattcttgacttattggaaattccatacagagttatagaattatgtacaggtgatttaggtttttcggctgcgaaaacatatgatattgaagtatggcttccaagctataacagatatgtagaaatttcatcatgctctaattttgaagattatcaagcaagaagagcaaatataagatatagagataaagacggtaatgttaaatttgttcatacacttaacggatcagctttagctgtaggaagaacttttgcagcagttttggaaaattatcaaaatgaagatggcagtgtaacagttcctaaagtattaagaaattatcttggaggattagaagtcataaaatagactttttagcttatggaaaaaagagtaagaagagtaaaaaaagtaagaaaaaataagataaaccctaaagtgaagaaagaacaatttgaacttgaaaacgaaatagaaaaacaagaatccgaaatagaaatagataattttaatattgacgatttggatatggaagatatttttgttaatacggattttgaagcaagagttaagtctgatgatgagaatataatagaagataatcctcttgaagatgaaggttttcaagaaaaaataatagaagatagtgaagatatttttgaatatcaagaagaggataaaaaagaaagagtctctttaaaagaagccttgaattttaaaataacaaaaaagactgttttgatattcttaggtattattattaccgcttctgcgttgggttttgggctttataagttattcccgggaggaaaaacttttagtggtattgtaaatttgaatgatacattatcaaatggtaaagttgaatgtgttgttgaagatattgttgttactgatactatatctacaataaaagccagtgaaggtaaaacttttgtatgtatttattatgaatttacgaatatttcaggtaatgaaataaaatgggaagattttccttatattactcttggtatttttgatagtgatgatattggttcaaaatcaataaaaatattggataatgatagtatcaataaagatgctttaagagaatattcatatgtaatggggcttgatcttagggatgatttagatcccctagctgcatcttcaactagagatgatgtagatgtttttgagatagacaaatcttatttaacaaataataagatatatttattatttgacatatatgataaagctataaaagttgaagaaggtttgagtacacttcctaacttagatgaaacaattgaggaaaatcaagaagaaataaaaaaagaacaggaagaaatgggtattcaagagacaccacaagattctgaaaattcacagtaaagataaagcaataaacttatgtttattgctttttattttaaaggagaatgattatgtttaaaaagggagataaaataggaattgttgttctttcaaatggtattgataaaaataaaaaagaacaagttaaacaattaattgttgaaataaaaaatttaggacttgttcctataattggagaatatatttacagtgaagaaaatcattgcctgttaatagcacaaaaaaaagctaaagttttaatggatttttataaaaataaggatataaaagctatatttgatatttccggaggaaatttggcaaatgaaatattaccttttattgattttgaaataataaaaaataattataagcttttctttggatatagtgatttgacaactgttataaatgctatttattctaatacaaaaaatccttgttatttatatcaaataaaaaatatagttttagataataaagaaaaacagatatgcggttttaatgaaagtttctttaaggggaaagatgatattttcaaatttgattatgagtttttaagaggagataatatgaaaggtgttgttatcggaggtaatataaggtgctttttaaaacttgccggaacaagttatatccctgactttaaagataaaattttatttcttgaaagcaggagcggaaaaagccctttgatgatatcattttttaatcagctaaaacaaatgaatgtatttgaagatattagaggtattattcttggaacttttactcaaatggagagagaagatagttgtcctgatataaaacaaatcgctcttgatataacaaaagaatataacattccgattgtaaaaacaaatgaaataggtcatgggagcgattctaaatgtattgtaataggtaaagaatataatttaagtaaataaaaaaaggaggggatacctccttttttcgtacgaataaataaatcttattcaggttgagctgctcctgttgggcaagcgcctgcacaagctccacaatcgatgcatgtagcagcatcaatttcgtattttccatcgccttcagaaatagcacctactgggcattcaccagcacaagcgccacaagcgatacattcatcagtaattacatgagccatgtttaatacctccatattatttgtttgtttgtattaatataacatttttaataatttattgcaataggaaaattttaaaatcatatattgtaatatatttaaaaatcataaattgaaagcatattataatatgaaaagtaattaaaagtaacgtttaagccttatttaagggtgttttgcttttctatgtaaagaaggaggaaatactcctcctttgttattttcttatatcatcaaaaaaataaattaatattccatcacatgtttttattattctgcagttacatttatttttacatttacaacaattattattacaacagctactatgatttgtatttatgcaatgactttcttttttgcatgcacaatttgatgagttttgattattgcagttgcattttgagcaagaattatttctttgttcgttttgatattcaatttcattatcgtaacatccgcatctgtcttgatttgttcttatagaagaattgttacatccacatgatgttctatttgagtaattcatttatcttaccacctttattgtattactgttttcgatatataatatgaaaaattataattttggttaccctttacattatttttgtaaaagcaaggattattaaaagtattccgctaaaccagcttaagtttatttttgatgcttcactgaagatatttcccgttttaaatcctgcaattataagtgaaaaacaaatgcaaaaggtaagtataaagactataaaaatgtttgtataagggaaagacagtcctgcgcatattgagtctattgacccgagaatgccgattaaaaatgattcttttatatctaaattatttgaattatttacatccgcttttgtttcatcaataaatatgttaaaaaataaattttcttttttaatttttttattaatatttctattaattatttgcatatttttaagatatgtttttattgcaaaggcaaaaatattgtagctgcctattgttattaaaagaaaaaacgaaagtatgttaaataaatatatcggtattatctttgaaagaatatttgataaagagatagacaaacaaagagaaaatgcacttgaaagagaaattataattgatgtaggtatattaatttttattttattacttccaaaatttgcacttattagaaaagtatccatactaagggccaatattaaaataatgatttttatcattcttgttcctcccttttatagtcataatttataatattaaataaaaagacttttcgtgcatgtttgaaattattaatattagatatataaaaatttataaatttatggtatatttaaaataagataacttattttatggaggacgaaatggatttaaaaaaattacaaaatggttctgatgtcagaggtattgccttagaaggtgtaaaaggtgaagaggttaatttaacaaatgaagcaagttataaaatagcaaaagctttttcaatatggttaaagaaaagactaaataaagacagcgtaaaagtcactcttggtagagattcaagactttctggtcctgcacttgctgaaaatgtaatgaaaggtttaagcagtgaagaaaatgttgaagttgtttactttaatttatgtacaacacctgcaatgtttatgagctgtgtaaatgaagaagttaatgctgatggtgctatcatgattacagcaagtcatttaccattcaacagaaatggtcttaaattctttacaaaagatggcggagcagaaaaagaagatattatagatattcttacaattgcaaatgaaatggaattagaagatgttgaagcaaaatatgaaactcttgatttcttaagtatgtatgctgctgatttagtaaagaaaattcaagaaagaaccggagaagaaaaacctttcagtggtaaaaaaattatcgttgatgcaggaaacggttcaggtggattctttgcaagcaaggttttggaagttttaggagctgatacttcaggtagtgtatatttagatcctgacggaagtttcccaaatcatgttccaaatcctgaacttaaagatgttatggacagcttctctgaaatagtaaaaaaagaagatgctgatcttggaattatctttgatacagacgttgacagagctgccgcagtagataaaagcggagaagaaataagcagaaataaacttgttgctttaatggcaagtatttgtcttgaagaagctgcaggaagctatatcgtaactgacagcgtaacaagcagcggattaaaagaatttatagaagaaaaaggcggagttcatcatagatttaaaagaggatacaaaaatgtaataaacgaaggcataagacttaacgaagaaggaaaagaatgtcttcttgcaattgaaacaagcggacactgtgctttaaaagaaaactacttcttagatgatggtgcttatatggttgtaaaaattcttgttaaattctttgaacttagcaaagaaaataaaacatttgatgaccttataggttcacttaaagaagctaaagaagaagctgaacttagagctacattcttagttgaagattttaaagaatatggtgcaaatcttcttgaagactttaaggtatatgttaaagaaaaaatggaaggcgctagttttgaagaaccaaactttgaaggtgttagagtaaatgttgaaagagacggaataaaaggctgggtgcttttaagattatctctacatgatcctgtacttccaataaatatcgaatcagaaaatgaaggcggagttgaaaacattaagaaagaaattttagacttcttaaaagactacgaagttaaattctaattaaataaaagcatcaataagggtatctttattggtgctttttttatataatataaaaaaagttataggtgtttattatggaatttaaaaatgtagttgacggagaatttgaagaagtaaaaagcagttttaaaaataataaggtaaaaagaaagttaaaattacccaaaatgaaaataaggaaagtagttcttcctttaatttttgttttgttttttattggactatttttatatttgataaacggattttatatagattatttatggtttaaagaagtagggtacttaaatatattcttcaaagaattaaagataaagatttatatgtttgtgcttctatttttaatattatttattttttttatggtatatataaaattcttaaagaaatcatttgatcaagaaaataatgttttaaataaatattggaaaaaaatatttgttttaacatcagtatttttttcttttatattttcttttatcattacttcaagattatggtataaatttcttgagtttccaatctatatgaagagaatatataaataacatatcgaaaataggcgatatatagtactatagctatatatcgcctattcatatttataaaatctattttatttcttgttctaattgattaaactctggagaattaaaaaattcacctagtgtaattcctaaaccgtcacatattatttttaaagttataattttaggatttttacttcttccatataatattccctttaaagtcgaaggtggtaatgcagacagattagctaatttatttattgatatatttttttgattacataattgtaatattcgtattcttatagcctctatagtatccattgaaattcctccatataaaaaggatataaaaaaacactagaaattataggcgatatgtgatactattaggctatatatagcctataaggagaatttatatgaaatcaaaaacctgttgttttagcggacatagaaatatccccgctgataaagaagaagaaataagaataaaattaattgaagaattagaaaaacttataaataaaggatattgttttttcgctgtgggaggtgctttaggatttgatacaatggcagcaatagaagttttaaatttaagaagaaaataccctcatattaaattaataatggttctgccttgtaaagaccaatcaaaatactggaataaagcagataaaaatatatatgaatttataaaaaagcaaagtgataaaattgtatatacatcacagtattacaaagataaaagttgtattttggatagaaacagacttttaattgataatagcagtgtatgcattacctataaaacaaaaaatacaggagggacttcttatacaataaattatgcaaaagaaaaaaatattaaaattataaatttagcttaaatacataaaagcaataaaaaaagaggcaaagcctcttttttttattttatcttattctcttatttttcaacaaaagatttacctgtcatttcttcaggttgtttaatatccattaagtcaagtactgttggagcaacatcgcataaagctgcttcttcgcttacgcctttgattaatttgctttcaacaatacatcttactttatttgttgtatgagctgtgaatggttttccgtcttcaaacattaattcagcattaccatggtcagcagttataataacgctgtaatcattgtttcttgcagcatcagtaacttctccaacgcatttatcaacagcttcaacagcagctacagccgcatcgaatatacctgtatgaccaaccatgtcacaatttgcaaagtttactgcaataaaatcgtaatctttattgttaattaaatcaacaagtttatcttttacttcgtatgcactcatttcaggttttaagtcatatgttgcaacttttggagaagcaactaaaactctgtcttcacctttatattctgtttcaacaccaccgttaaagaaatatgttacatgagcatatttttctgtttcggcaattctaagttgagtgtatccgttattacttaagtattcacctaaagtatttgtaataacttgtggtttaaatgcgattaatacgtttttaaagcttgcatcataatttgtgaatgtaacaaaagttaaattcaaatcttcttctctatcaaagccgtcaaaatcatcttcaactaaagctcttgtgatttgtcttgctctgtcaggtctgaagttaaagaaaattacgctgtcgtttttagaaatttttgcatcttcacaaacaatcgtaggaagaacgaattcatcagtaacatcattatcatatgaattttgcatagcttcagcagcactgtcggctttttcaccgataccatatactaaagcatcataagctttttttgttctttcccatcttttgtctctatccattgcatagtatcttcctgatactacaccgattttacctacaccgatttctttgattttttcttcaagttcttcaatgtagcctttaccgctttttggaggagtatctcttccgtccatatagcaatgaacataaactttttctaaaccttgtcttttagcaagttcaagtaaagcatataaatgttcattagaagagtgaacaccgccgtcagagacaagccccattaaatgaagagctgagccgttatcttttacattttgaacagcttttaaaaattcttcattttcaaagaaatcaccgtcttttatagactttgtaattcttgttaattcttggtatacaattcttcctgcacctaagtttaaatgaccaacttcactgttgcccatttgtccgtcaggaagaccaacgctttctccgctgcaatttaataataaatgaggattgttttcccataatttatctaaatttggagtgttagcgctgtatacggcatttccttcatgactagcagaatatccgtatccgtctaaaatcattaataatactttattactcattaattccacctattatagttctttgtagtttacaagtgtaacaaaatcagcttttaagcttgctccgccaactaaagcaccgtcaatgtcactcatagacattaaagcttttacgttacctgcgttaacacttccgccgtaaagaattctcattgcttctgcaacttcttcaccaagtaattctttaacaagacttctaatatatccgcaagcttcgttagcttggtcatcagtagctgttttacctgtaccgatagcccaaacaggttcataagcaagaataattttcttagcatcttcagctgagataccttcaagtaattttgttgtttgttcttttaatacatcaaaagcttttccgctttctctttcttccaatgtttcgccaacgcatgggattggaattaagccttttgctaaagctttctttgtttttttgtttacgccttcatcagtttcgttgaagtattgtcttctttcactgtgacctatgattacatatttacaaccggcttcaataatcatatcagctgttacttcacctgtgtaagcaccgttgtcttcaaaataaatattttgagcaccgataccaacattagtaccttttgtagcttcaacagcagcaggaattgtcatataagttgggcaaattacaacttcaggatctgctacattgattttatctaaaaattcattaaaaaattcttttgcttcggcagctgttttgttcattttccagtttccggcaattactgtttttcttgacattttatatatttctcctttaattactaaaattgtttatttgtcgtttgctgcaacaacaccaggaaggtctttaccttctaagaattcaaggctggcaccgccacctgttgagatatgagtcattttgtcaccaaaaccaagttggttaacagcagcagcagagtcaccaccaccgataattgttgtagcgtctgtatcagcaagagctttagctacagccattgtaccttttgcaagaattgggttttcaaatacacccataggtccgttccaaacaactgtttttgcagatttaacttcatttgcaaataattcagctgtttttgttccgatatcaagtcccatcatgtcagcagggattttattagaatcaactactgtgatttcaatttcagcatcgattggatctgggaaatcttttgtgattgttgtatcgataggaagtaataattttttgccaagttcttcagctttagccatcatttctttacagtaatcaattttagaatcatcaactaatgatgtaccaacttcatatcctttagctttaaggaatgtataagccataccaccaccgatgattaatgtatcacatttttcaagtaagttgttgattacgtttaatttatcagcaactttagcaccacctaaaattgaaacaaatggtctttcaggattgtttacagcattacctaagaagtctatttctttttgcattaagtaaccaactacagctgtgtcaacatattctgttacaccaacgtttgagcagtgagctctatgagctgtaccgaaagcatcgttaacaaaaatatcacaaagtgaagctaagtctttgcttaatgcttcgccgttttttgtttcttcagctctgtaacgtgtattttgaagtaaaacaacatctccgtcgttcatttcagcaactgcttttttagcgttttctcctactacattgtcatcagctgcaaaaacaacttctttacctaatttttcagataatctttttgcaacaggtgctaaagataattctggttttggttctccttttggttttcctaagtgagaacataaaataactttaccaccgtcgttcattacttttttaattgttggaagagcagcattaattctgttttcgtctgtgatttcaccatcttttaaaggtacgttaaagtcacatctgattaatactctttttccttttacatttatatcatctactgattttttatttagcatctaagagtgctcctttcaattttttgtaaataaaaaggtccgggccagtaatgatcccggacccattttggatctttgtaagttttactttgtttagaattaattaagctaattctgagaagtatttgattgttcttaccatttggcttgtgtaagagttttcgttatcataccaagatacaacttgaacttgtgtatcaccgttttccattggtgaaaccattgtttgtgtagcatcgaataaagaaccatatctcatacctacgatatcgctagatactaattcttcttctgtgtatccgtaagattctgtttgagctgctttcatagcttcgttgatttgttcaactgttacattacctttaacaacagctactaagattgttgtagaacctgtaggagttggaactctttgagcagaaccgattaatttaccgttaagttctggaataactaaaccgatagcttttgcagcacctgttgagttaggaacgatgttaactgcagctgctctagatcttcttaagtcaccttttctttgtggtccgtcaagagtcatttggtcacctgtgtaagcatgaattgtgctcatgataccagattggattggagctaaatcgtttaatgctttagccattggagctaaacagtttgttgtacaagaagctgcagaaataactgtatcttctggttttaatgtttcatggtttacattgtaaacgattgttggaaggtcgtttcctgcaggagcagagataacaacttttctagcaccagcttcgatgtgagcttctgcttttgcttttgatgtatagaaacctgtacattcaagtactacgtctacaccgatttctccccaaggaaggtttttagcgtcagcttctgcataaattttgatttcttttccatcgataatgatagaatcatcagttgcagatactttgtctgctaattcatatctaccttgagatgagtcatattttaataaatgtgctaacatctttggagaagttaagtcgttgattgcaacaacttcataaccttcagcgccaaacatttgtctgaatgctaacctcccaattctaccaaatccgttaatagctacttttactgccataataaaattcctcctaaatattataattatttattattttttcttgaagttccaaacagaacttctaaatagtagcaagtttaaattagccccaatattcgagcataaattgaactttaagagtattatatataaaaaaattactaaaatcaataatttatatgaaaaatgaatcaacttttttttaaaatttaaacagttttgtttatttttagttttagtattagtgttatgctattttcaaattttttcaataaaatttttttatttgactacttacttttatttatgaaaatcttatttttaataatatttacatagatattttaatgtatacatcatattttatttttcaattataaaagattgtaaactttttttacatccatttttctcataaaaattttgggtcccaggttttgaaccgaaatataacattgtaggtgtatgttcttttgcaagttctaaaagtttacttcctatccccttcttttgatactctggaagtacaagaaggtcagttattgttccaaaaaagtatccgtctgttaatattcttatgcatccaataagtttttcttcgtcataaacagttatattcatggtttttgttaaagcattttttgtttctaaaacatcatactcacctttccaaatttgatttacaaaggaaataaaatcttttacattaatatctttatcatctattttataattcatcatttttcatatcctatctaactattcatgattttattaaacatttattttaaatatatttaatatattaataaaaacaataacattattttatactttatacatatataataaaattattacataaattataatttattatttaaaaaatttaatatataaaataaaaaagcgtcggtaatccgacgctttatattaagcattttcttcttcaaattttttcataaattcaactaatttttcaacaccttcaataggcatagcattgtaaattgaagctctcattccgcctacagttctatgtccttttaagtttacaaagcctgcttttgtagcttcttcaacaaattttgcatctaagtctttgtctccagttacgaaaggtacattcattaaagaacggtcttcttttacaactgtgcctttaaacattttgctttcatcaagatagtcatataagatttttgctttcttttcatttagttctttcattttagcaagaccaccttgttttttaagccacttaaatactttaccgcaaatgtaaataccatatgcaggtggtgtattaaatagagaatcattgtcagaatgagttttatatcttaacattgtcggaactttttcatcaatttcatcgtctgatggaattaaatcttctctgataattactattactacacctgcaggacctacatttttttgtaccccaccgtaaatgataccatatttttcaacatcaacaggttctgataagaaacaagaagatacgtcagcaaccaatgtttttccttttgtattaggtaatgtatgatattttgtgccgtaaattgtattattttcacaaatatatacataatctgcatcttcatcaatatctaaatcagagcagtcaggaatataagaataagtcttatcttcacttgaagcaactgcttttgcatttgtatattttttagcttcgttataagctttttttgcccattgtcctgttattatgtaatcagcaacaccattttttgtaagattcataggaatcattgcaaattgttggcttgcacctccttgtaagaataaaaccttataattatccggaatattcattaattctcttaaatctttttcagctgttttaatgatgtcatcaaaccattttgaacgatggctcatttccattacagacattccgcttccattgtaatcaagcatttctgccgcagcttcttttaatacttcttcaggtaaaacagcaggacctgctgaaaaattatatactcttcccattttataaaatctcctttatcattactatattattatatttgtttaaatttcatgaataaataatccgcttctaagttttggttcaaaccaagttgattttggcggcatgaccatgtttgcatctgcaactgagaataaatcatccattgttacaggatacactgcaaaagcaacaccgttaaaactatctgctctttgttcaagttcttttaatcctcttattccaccaacaaattctatgttgtcacttgttcttggatcttctatattaagtacaggtgcaagaagattttcttgtaaaatatctgcatctaaactttttacaggattttctttgtcataagttccttctttagctcttaaaagataccacttcttatcaagatacattgaaaaatcatgttttttatcaggttttattatattttcatcatttgatacaatatcgaatttttcacttactttatctaaaaactcttctttggaataaccagctaagttttttacaactctgttataatccattatttcaagttcatcactatcaaatattacagctaagatatagttgtattctctatcaacattatctcctgcttcttctctttttctttttcctacttcatatgaagaagctgttctgtgatgaccgtcagctatatataaatattcaattttattataaaattctcttactttttcaacatcttcatctttatcaacaacccataaaatatgacttattccgtcttctgctacaaaatcatatacaggtttattgttttttgtatattcggatataaaattatgtaaatcttcgttatgtctgtgagcgaagaaaacaggttctgtatgagccgaacaagccaaaaagttatttattctatcaacttctttttccggtcttgtaaactcatgtttctttattattcccttttcatattcgaaagtggaacaacatccacaaatccccgtttgaactcttccgttcattatttctctgtagatgtaataaacttctttttcctccctgattaaataaccctcattcaaaaatttatcataattttcttttgctttttcataaactttttcatcgtgtatatctacactgtcaggtaaatcaatatcggagcgtacaatatgcaagaaggatttttcatctttacccatttctcttgcttcatctctgttcattacgtcataaggtagacaggatacttcttttgcatattttgcatcgggtctaacacccttaaatggttttactattgccatattttacccctcctaaaatattattaaattaaataatatcattacttatatataacttcaagaatttttagaaaattttttcataaaaataatgattaattttcatttttattccataatataaatgtaaatcgttttatatcaatttgacaaatataattgctattgatataatttaaaaatatttaacataataaaaataataataaaaataggagaaaacaaatgaatattgcaatcatgcctgccgcgggcattggttcaagaatgggagaagtttgcaaagaaattccaaagcaatttttaaaagtttttaaaaaaccaattatgatatatactttagaagtatatgaaaaatgtaaagatattgatgctatcattgtagtatgccataaagactggatggatttcttaaataaagaaatttcaaaatcagaattaacaaaaattaaagcagttgtacctggaggcgctaccggacaagaatcaattaatatagggattcatgaggctgaaaaattaattacaaaggatgatgatataatcattattcaagatgctgtaagagcacttgtaagtacagaattaatttcaagaaccatagatagtgcaaagaaatttggagcagctgcaacagcggttgaaaattcatctatattatatagattggatgaaaacaagaaaccttatgaatatataggaaaagaaaaaatatttttaagtcaaacacctcaagctattcagtataaaaaaatgatagacacacataaacttgcaaaagaaaaaggaattttagatacaagtgcaacatgtcagttattatttgacttaggggaaaaaatccaatttgttcaaggagatcctatgaacattaaaattacagcaaaagaagatttgaatttttttaaagaagtaataagaggaagaatggcaaaagaatggttaaataaaatggatgaagaagattatcttcaaaatatataaaaattatataatcaacaatcaaatgtagcatcaagtatcgatgttacatttatatttttaatcagaggaaaaaaatgggtaatataaataataaagaatatttaaaaacaaataaagataaagttcttaatggacttaaaataatccaatttaatgcattaaaagaaattgatagaatatgtaaaaaatataatataacatattcactatcaggtggaacatgccttggagcaataagagataaaggatttataccttgggatgatgatatcgatattgaaatgatgagagatcaatatgaaaaatttatggaagtagctccaaaagaacttgatccaaacacatattatatggtttcgtatgatattgataaaaaatatcataatacaacaccaaaactaatgataaaaggaactcaactaagaacaagattttatataaaaaggaattatgataatccaatttgtgtcgatttctttatatatgattatgtaccaaatgatcctaaaaaaaggaaaaaggtaacaacaaaaatatataatttacgaacattaatgttatttaaatggtttggcgtaacacctagaataccaaaaaaatacgtttctttcgttaaactaatattaaaatttattccttttagacttatacactatttacatgatagtactgttaagaaatatggaaaaattccaagtgattggattttagaaacagcagtagtaaatggtaattatggtggaatgcctgtatcagaaagaaaagagcatatagaagtagaatttgaaaatcaaatgtttcctgtaatgaaaggatatgatacttatttaagaaggttttttggaaacagttatatgaaatggctaccccctgaaaaaagagtttctcatcataaatggtcagaagctaaatttggaagatttgttgaagaatacaatttagacattcctaaagactatgaaaaatatttaataatgaaacttaattcagaaagacttgaacatgtaaagaagttaagtctagatatgttagatgaaataaaaagaatatgtgacaaaaataatatagattattttataacaggtgatgatgcaattgcaaaagcttatggaattgaaaatgaatattcaaaatactggcgtaatgatatggcttttgcaatgacacaagagaattttaaaagatttgataaaattgtcaaatcagaattagaccctaaatatttttatcaatcaagagaaacagaagatgattataaattaatttatcctaaaataagattaaataattcaatatttagagataataaaacagtacctgcagatataaatacaggattatggataaatatagttattcttgcaaaaacttcaaataatgaaaatgaaagaaaaaaacattataaaaaattaaaaaaattaaattcattaataggacgttttttatgttttttatttgagggagtaggatatttaaggaattctttcttaacaggatgtatttaagggagtttacttttcataagctttattttttgtttactattaaaataaacagtttgaattttaaacagtataagtgaatttttatgaattataattattacaaaataatattttttaattcaaaaaataattatattgaggcagagagttcttataataaacaaaatatcatatataaattatgaaaaaaaccggcgtatttaaacgtcggttttatataaaattattaagtaaaggggaacaaattaatttttattttaaactatcagtccattgggtaatttcttcacttgaaggagatgaagggaaacgatatccttccatccagtttccgccgtttgctttttctttaagcaatttaccgctgtctcccaaatctgatgaagcggaagtacagaaaggtattacgtttttgtccgcaaaatcgtttgcttccacaaatgtatcaacgggccaagccgcaattccccaccaaatagggtaacctatcaaaacattttcataactgtcccaattatcaatcgttgttgaaacaagggaagtgtctcttagagattcgtcttcatgttctcttgtaactctggaattgtcatctgtccagtttaaatcgctttctgtgtattcgtcttgaggtacgatttcaaaaatatcggcatccaaatcttctgcgatttgttccgccacgtctttcgtatgtccttgtgccgagaaatataccactagagtttcaccgtcttttagcgagttttcgcttgatgttaatgtgtcttgagtttggcttgggggttgtgatgccgtgttgtcgtttgtgtttctgttatttacgaaaagcaacaatgcggctgcaataaccgctaccacaacaacggcagctattatttttgtacttgtttttttcattttttttctccttttttattttattttttttcttcttgtttttaccaattcgtcaaaccattcaaccattcccggatcttgatgattaaagaacaggctgtcgcttgaatccagttgttttattttatccatatcttcgtttgtaagttcgaaatcgaaaatatctatgttttctttcattctttcaaaatgtgttgttttaagtgctactataactcctctttgtataagccatctaagaattacctgagcagatgttttagcgtattttttacctatgtttaccaaagtttcatttgtaaacatattattttttccctctccaaaaggtgcccatgcttcgatttttactccgtatttgttcatgttttcctgagctttgaattgagcattcattgggtttgtttccacctgatttacggcaggaactacttttctttcaaaaaggcaaatgtcgcttaatctgtcgggataaaaattggatactcctattgctcttatttttccttctttgtatttttcttccaatgctttgtatgcaccgtaataatcagaaaaaggctgatgaagaagaaccaagtctatatattcgctttgaagtttttccaaagattcttcaatggactttttgcatttttcatatccgtaattgtctatccatattttagttgtgataaataaatcttctctgtttaatccgcattcttttattgcttctcccacttctttttcgttaaaataactttgagccgtgtctattcctctgtatcctgcttttattgcatcaagtacgcattgttttgtttcttctttcggtatttgatacactccgtaatttaaaatgggcatttctacgccgttgtttaattttacatattccattttcttttttcctccttatagtttaaaataagttttatatatatttatttagtgttttatctatattttttatttttgtttttaataaagttatgtcttataaagtaaaacttttctttaatttttattattttaaggaattattaaagttttttaacttcagagtaagagttatgttatttttagtctagtttttatgttttcttttatcagctttaaaagttttttaattccttttttttttttattctgtttgtgatagttgtttaaaatagttttagttttattcattgacaatgaaataattttttattacaatgaaagagtaacactcgggagtaacacacggtcaagagcttttttataaaaaaaataaatatttttttgaggtaattatatggaaaatgaaaaaaatttatattcgatgaagcaaacatgcattaaaacgggacttacatatgatactttaaaattttattgcaatgaggggttagttcccaacgtaaaaaggaataagagcaattacagggttttcgacgataatgacgtggaatggataaattcgctttcatgtcttaaaaactgcggtatgagcatatcggaaatgaaagagtatcttaagttgtgccttgagggagaggaaaccattccgaaaaggcaagctatattggaagttaaacttgaagaattggaaaataaaaagaaagaaattcaaaagagcataaattacatacattggaaacagaatttttataaagatgttcttgaaggaaaggtaaaatattttagtcatttaatagatacaacaaaagacagccattaatgactgtcttttttattagatgtattctaagagatttgttttaaacgtccaaattttcgtttaattccatttgtgcgtatttttttgtctgttcttcccttggaatgtagtaacgtttgtttttgttcaaattgtctataaggtcgatttcttcgtccgtaagagaaaagtcgaagatatttatgttgtctttgatgtgagcaggatttttgcttcccggtattactatgtttcctgattgaacatgccatcttaaaatgatttgtgccgggtttttttgatatttgtctgccaaatctttaaatactttttcgtttataagttttttgtctccatgtcccaaaggataccaagcctgaattaatatatcgttatctttaaggattttcttaagttcgttttgagggaaataagggtgagcttcaacctggattaccgcaggttttatttcacatatcgaaagaatttcttccaaaggcttaccttcaaagtttgatatacctattgattttacctttcctccttttactgctttttccatcattttatatccgttgatgtaatcgccggcaggctgatgtagaagaaggagatcgacgtaatcggtgtcgagtctgtttaacatttcgtctatggctgtttcttttgtgtaaacggttggccataattttgactcgagaaatacttcttctcttttcattccgctttttttgattcctcttcccacggctctttcgttatgataagcgtttgctgtgtctattaagttatagccgttgtttaatgcgctgataacggcgctttccgcatcctgcggacttaataaaaatgttcccagtcccaaagaagggattttgttttggtcgtttagtttaaaatattccattataatttactccttttataccgataaaagttttttttgttaaaatttaatccgattttgaaatgcattttgttttttacatatgctcttcccagaattttacagcattttctatccatccttgcgcatttgttccttccccaagaccgaatccgtgggaaagaccttcgaatatttcgatttttgcatctgttccgtttcttcttattctgtttgttctttcctgcattattctgtagtctgcaataccgtcatttgttcccacaaccgagtatgtcgcaggttcgtttcccgttacttcgcttaaggaagtatactgcataattaccgtggaaggtttcggataatctttgtttataaagtaatcggtgccgtaacttccaagccatgctgccattcttcctcctgcggaacctccccatacggaatatccagaagtatctattttcaattcatctgcattgtcaaaaataaaggatatcgcattggacaaatcttccattgctttttcggggtccggtctgtatattaatgcaaaagcattatatccctttttcgaaagttccagtgcatggggaaaactgtcgtgcattgctccgacgtacataaatcctccgcctgcgtttaaaacggcaaactttgagttttcatttcctctaaagaaaaacagtcccgtgtttttcttttcggggtcggcttccatttcttcttttgaataaatattataaaagattttattgccttttgttgtttggtctttcatataatttactatttcaacggttttgtttggatttatgttgttataccaaatgtataaatctcccgcattttcgagagtcatgtcctttggaatgtttctgtcaacggggaaaataaggtttccgaaaccttcaaaagcgttgtcgtttatgacgtcgtatacttttgtctgtaaattaaaagcttcgtttgtattattattgtttttcattgtattgccacatcctgcaagaaacggaataagaattaaaaaaactattatgtttaatgtttttttcattgtatttgtttatttttctataataagttctttttttattttagaagcggacgaattgtctacgacagattttttcaaattcattcccgtaagttttgcaagtctggttataagaaaagttatcgtttcttccgttcctttatccggtgcagaaccttgagcaaagaaataaagttttttcccttttaggttttccgctttcggaagcatatagagtctgtctatgaatgtttttagcaagcctcccacgctgtaccaataaacaggagagcctataagtaaggtgtcataattttttattatatccaaaacttcgtttatttggtcatcttcgtacacctgtccgtattgagaaatcttgtaatcagaaagctgaagttcatcgtgagggatgttttttaaaacgtcttttccgattgaataagtattttgattttttctcggacttgtattgataaataatatattgctcattttaatcactactttcgatgttatgatatacccgtgagtcgctcccgtgtcaatagaaaaaataaaaacttgaccgtgtgttacacacggattttacaataagctaaaggagatgatattatgaaaagaaaaataattattttatttgttgtttttattttaattgcagtggttttggttttaacgcttttggaaaatgaaagaaccgaagaagaacaaacggaagttttgacaggcaattctttgggtgagtttatcacagacaaagtttacaactctccaaatgacggagaaatacattatggcgtatattatccaaaagattacgatttaaacaaggagtatgatttatatattactcttcccggatatgaaggactttattttcagggagttggagcgaatcttgaagcggaagattttgctttaaatgcagtaagaatgagaaaggaccttatagtcgttgcaccacagcttgaagattggggagatacttcagcaaatcagacaatagctttgatagagtactttaaatcaaattacaacatagacaaggtttttgccaacggttattccgcaggaggagagactatgtctttggttatggagaaaagagccgatttgattgacagatatttgcaggttagttcaaagtgggacggggattttgaaatgacggtagaaaatgaagttcccgtttattttgtcataggacaaaatgatgaatattacggaagcgaaccgacaaaagatgcgtattatacgttgtattcgatgtatcaaaggaaaggtttaagtgaggaagaaatagatgaaatattgattttggatattaaaaaaagagaatatttccttgaaagaggatttgataacgaacatggcggaggcagtttaattgcttatgatgaagatataatgaaatggttattaaatgattgataatatattttatagattgaatagttatttcatatttatggtataattttataaagagtttggagaaatttttatggaaagaagttcaattataaaagattattttattcttttacttgataaaaaagggaatatgcctttattatatcaaaaggaatccaatgcgggttttgttgctgccgggatttttgatttattattttcgggaataataaagttagaaaaaaatgaaattaccgttattaatcctctttacggaaaattgacatatctttatcctttatatgattatttaaaagaaaagccaatgaaaatcgaaaaagcagtaaatgatttttgcaccggaaacgactttaaggaacttgtaagctgtgtgtcagaatctctttacagcgaaaaaaaagtcataaaaacaaagggtggtttctttggtaaaaaaactctttacataccaaaagatgattataaaacttatcttatagataacattaaaaatgttattacatgtaaggaaaacataaatatggaagatgtttctcttatttgtgttttagatgaaacgaaaaacttaacgaaatacttttcaaaatatgaaatggcagagtttaaagtaagacttaaagagattaagaaaagtgaagaaaataaagaattaattggtgtaataaacactatttcttatacgatttctgctattaatgttaataatatataaggggcgttgccccttaaactccgtatttaagggctgtctgcccttaacaacccgacatcaaggggcgttgccccttaaaccccacgacttttttattcgcctaaaaaagtcgaataaaagggcgccactgggcgtggagccttataacgcatcgggatttcatggaaaatctacccgattttcctatgaaccgatgctaccccgagccgacctgtttatacgttttattaaagggtggggaacaaagctgtaaaattatagttttatttttatgtttttatgttagtgtgtgggacattatggtgaaatagaggggtcgttctttatgattttatgtagtaaggtgggaattttatgggattctttcttaacaatccgtatttaaggggtgctaccccttaagaaccccgccatatttttgctaaagcccaaaaatatgggaaaaaggctttcactcacacgccgtgaaggcttataacgtggtcggattttctaaaaatctctacccgagatttttgaaacgaccactaccgctacccaatcttattattattttgtggagtgggacatgggtgttaaatcaaagttatgactttgtttgaatggtttaatgtaaaatatttgaacatagtggtgaaatatgagggcagtattttttaatgtttttatatagtgaggtggggcaaagcaattaaattaaattaaatttatgactttgtttgaatggtttaatgtaaaatatttgaatatagtggtgaaatatagggcagtatttttaatgcttttatatagtaaggtgggacataaaagttaaatgtagaggtagtggtttatgatgttttatgtaatatggtggggtatgggtgttaaattgaagttatgactttgtttaatatgttttatataattaatagaatatagaattgaaatgcggatttcctttttgatactttttatatgagggagttgggcattatggtgaaatagaagttttgttttttcatgtttttatgtaagaaagtgaaacatcgttgtgaaatagggggtaagtgttttatcatttttatattaaatagtttgggtgttatgatgaaatttaagtttatattatgttgatatactgttttgttttatttaatttttaatattattacaaataaaaaaagacttgttcccaagtctttttaatttactatatgttcgctttctttttctttattccacaaataccatggcacgaatgctacaaaagcaagggcaatacatataaatgtaattattgctacacttccaaagttacccgcaaaggcatttattttggcagggatatagcacattatttcgtttatgtagttcttttggcttacgaaagaaagtagtccatttaataaaagcacaaagaatataaatacaccgtaatgcacaacggattttatatgttttatgttgtggtaatccacaaatgtaaaatagataagtgaaaacacaacgaagatattacatataaagaactggtaaaatctaaaatgcgtatagccatatcctccaaaatcggcaaaaataagatttattattgaaaagaaggatatgaagtaaaacaaatcgtaaaaaatttgttttcttgaaaagaacagtaatatagaaagcaccattgcaataaatgtaaaatcaaaggggattgcataaatgatgttttgttctccacttatggcatatgcccagacgatatatatcatctcaaagaaaaatgcaaaaaatgccataaaaatataataccatcttcctgaaaaatttcttcttattgttcttcttctaagaaacataaaaagacaaattagaatacatacccctatccatataaaatgaaaaagagaaaatcttgtaaatatgtttgcagtattttcgacgcttaaaaaattcatatttttctccttaaagttcaagttgaatgttttaaataattataacatataatataaaattaaaaaaatttttattgcaattttattttattggtgtaaacttaaataaaaagggcatttttagggaggtgcgacatgaacaaaaacactatttggcataatatcgatccaaaaaggattagtgccgacgattttattgcttatatagaaattccaaagggaagtaatgtaaaatatgaacttgataaagaaacaggtcatattattgttgatagaattttatacacatcaacacattatccgggaaattacggttttattccaagaacatacggagatgacggagaccctcttgatgtaatagttctttgcagcgaaagtatttatcctacaagtttgataagatgttatcctattggagtacttaatatgatagatgacggagaaaatgacgaaaagattattgcaataccattcaatgatcctacatataacttctgtaggacagtaaatgatctaccaagtcatatttttgatgaaatacagcatttcttcagcgtatataaaacacttgaacataaggaaaccacagttgaaaaagttcttggggatacagatgcaaaagatgtaataagaagagcaattaaaaattataatgaaaaatttgaagaataagccgttatacgcggtttatttttttattttgtgttttaaggagttttaaatttaataaaaatatataaaagaaaactaaaaggtgcataataagattttatgtatatatttagtttttatttttattcattattatatttatataaatttataattttatattattttatatttttgatttttaatatataattttatatattaaattattttagatttttcttggtttgaaaaattattatagaaatattttttattattaattaaataaatatattaagataaatatcctttaaagtaaaatttaagaaaaaaaattaaaattttttttatatttttttttcagatttatataaaaataacgttaaaaataagaaaaaatcaaaaaaaaatttttccttaaaaaccgcattataaaaggggttttagagggtggtaaaaaaaaagaaaaaaagtttttaaatttgcttgacatttttaatgttttactgtattatatctcttgtgttcagtcgaggtgtagcgcagttggtagcgtacgtggtttgggaccatggggccgggggttcgagtcccttcacctcgaccattaatttttaaaggacactgacaaattttcttttttttatttatttattggtaagggcctttagctcagttggttagagcatccggctcataaccggacggtccggggttcgagtccctgaaggcccaccatttcttaagaagtattgatatcaatacttttttttattttatcaaaaatattttatcggtattaaaaggcttataaagcctttttttatttttatgtatttgtttctgttttgagggtttataagattagtaatataaagtaaataataaaataacaattgtataattaatacaaaaaaataaaagcatcttatatatggtattttaattagttattttttatatataagctttataataatttaaacattaaagttaaatttaattataatgttttagtttattataaaaaatatcctttttttatattaatatttaatacattacataacaataattataatattatcttacattaaactaccatgtcctacttctctatataaaaccaaataattaggcaggcttagggtagctttttcgccagtaaaaatcgggtagagttttacgtaggcgtcaaaagcgttaaggctccacgcccagtggcgcccttttattcgacttttttaggcgagtaaaaaagtcgtggggttcttaaggggtaacaccccttaaatacgggttgttaagggcagacagcccttaagtaaggggtttaaggggcaaagcccctttgtattgagttctaaaggaacaccacttaaatacccaccccttacattcaacgctaaattatgtgaggttggggtagcattccagcactaaaaatacgggtagtatttttagtaagcttcggaatgcgttataagccttcacggcgtatgagtgaaagcattttatccagtattttttgcttcggaaaaatactggtcgctctttagagcgaaaccctaaaaccccacgccaagtggcgcccttttattcgacttttttaggcgagtaaaaaagtcgtggggtttaaggggtaacaccccttaaatacgggttgttaagggcagacagcccttaagtagattttgacaatgatgtatttgaaaatacttcatataaatatttgaaaacatcaaggaatttaaaaagtgtaagaattacaagagaatttttcttatatttgtataagaaatttaagatattgatgtatactacaaatgatatttacgagtttatggaaaatattagaaatgaaagtgatgttgaaataaattattttacagtaagacttgcacttgatataatgaaagaaatgaatatattgaattattctcttaaaaatgataaacttagtctgtcgtttaataagataacaaaaaaatcagacataaataatactaatataatgaaaaaattaaattttagattggggacatattaatggatttaaagagtaaaattagagtaattgaagattttccaaaggaaggaataagttttaaagatataacaacacttataaaagataaagatgctttaaaagaaacaatagacagactttgtgactatattccaagtgatgtagatttaattgtaggaccagaatcaagaggttttattttcggaactgctgtagcttataaaataggtgcaggttttgttcctgtaagaaagcctggtaaattacctgctgaaacattaagttatacttatgaccttgaatacggcactgatacaatcgaaattcacaaagatgctataaaaaaaggtgataaagttgtaatcatagatgaccttattgcaacaggtggaactttagaagcgagtgcaaaagctgttgaaatgcttgggggagaagttgttgcaatagttgcattaatggaacttacaggtttaaatgcaagagataaattaaaagcatacgatgttcatacattggttgaatatgaattttaaataggaagtgagttttatggattattttatgatgtcgccacagattcttaattcaatatatctatgttgtgtgtatgtggctttggttggaataattatttttgctttacttaaaataagaagaataaaaataaataagggtaaaccgaatttagatgaaaatatagttcaaaataataacccttcaattttaaccttaagttctaataagttaagtaaatctttaactgtaagatacttttctatttttactatatcaggtttcttacttgtatttggatttatgggaatgcagacacttaaaaataacatcacaatgaagccaagttttgttataagtgtactgcttggttttacaggacttgttatttttgctcttgttgaatatgctgttgatttaatggttaaacatgatgctattttctctgcaaatacggttggtttagaagctttggtttacaaagatataaaagccaaaaaaggcggtacgggaaaaataagactttcaataaatgataaagttgttgaatttgatgccgtaacaaatgctgaagtaaccttgagaaaaggtgcaaaagtaactataacaaattcgctaagcgataccagtgtggtagtagaataaaaaaaacgcctttttaggcgttttatttttttaataaagaaatatattcatgttcttttctttttattatttttgatatttcttttatatatatatttgtatcttttgttgtatcaactctatatgttttatcttcattttttacatatacttttcctgccccaccggcgccaagagcaattacactacttttatttttcattgtttttatgttgtatatacattctctatctttttttgcaaatccaacattttctcccatacataaactttgcttttgtttgtacaaatagtatggattatatttattttcttcaagcaaatcaaagcatttcttttgaatagaataaaaattttcattttcaaattttatatgttttaattcgcttgctcttttaagtgcaagtgtatgtattgttatattgtctgcatttaaatctacaagtgtttttacttcatcaaaaaaggatataatatcttctttgtttaatcccatgattaaatcacagttagtaataaagtcgtatttttttataagttcaaaagatttaaagaattcttctttttttattcctctgttacataaatttaaaacatcttcattaaatgactgcgggtttaggcaaattctttttacgttgttttcttttaatatttttagcttttcttctcttacgaggtctgctcttccaagttcaaaagtaaattcaatatctgtatttatatatttatttatattttccattaacattttaagattatattcgtttagtattccgggagttcctcctcctatatatatggaatctagtttggtttgtgttttatctaaaatgttgcttatggattttatttcttctattaagcattttgtataatctgttagaatgctgttttcttcttttaatattgttgaagggaaagaacagtaagagcatcttttgggacagaagggaatatggatatataaacttgccaaatcatcgtttataagttctttttgtgtttgctttgttttaattaatagttttattttatcttctcttacaaaatagtatttttttagaatatgtattatttcttcctttgatttgtctttatacatatttaaaatgttaatgggttttactcctgttaaaactccgtaagggaatgatttttttgtttcttcttttaaaactttataaacaagtcttttggtggtatttttttcagatattttaatttcttctttatagatattgtttttatactctaaataaataaaattaccctttgagtataatttcatatagatattcttatactcttcagggtaaaatatttgtaatatttcacgaacgtgaatttcttttatgttattgtctgttgttatattcatttatgctctgaaaaatccgtttagtttcttttcctcttctattgttgtaggttctccatgtcctgatagaagagtgtaatttttatcaagagtataaattttatttctaattgaactttcaagctcagtaatgcttccaccatataaatctgttcttccgattgagcggtagaataaagtatctccacagaaaattacgttttcgtcatctattttataacaaaccccgcctttagagtgtcccggagtaaaaataacttcgattgtgcttccttcaaagtctattttttctttgtcaaaaacaaattcatctgcatcttttattgtgatattcattcccatcataagagctgaaccgtttttatttgggttagaaagcatttcgctgtcattttcatgaatatatactttggcacctgttgcctctcttaccatatcaactcctgcaatgtggtcaaaatgcccgtgtgttaaaagtattttttcaatgtttaagttctctttttttatataatcaataagtctagtatcgttatgaccgggatctattatgattgatttatcattttttgttacaatataacaatttgtgcctacggggccaagttgaaaagctctaatatccattttattttttcctttcttcaagtttacatagaatacagctcccttttgtaagaaagctttcttttttataatattttaccatatcagggtccagttcttgtaaaattgccatatgttttttacaaagagtttttccgtagttttcaagatatcctttaggaatatctgtttcgtataataaaggttctctttgaatgtcttcttcacatattacaatcatataagcttgatcttcatcgctgtaatccgttacaaatttaaaagatatgttgttttttgtaaaatattcgaccaaataagtttgaattgcatcatctgtcatttcgcttactattactttttttattggtaatgtattatttattttttctataaaataagtaacagattttgtatcggctatatcacccttgaaataacaatatatctcgtcttcaaatactccaagaattctttttgttttacagatattatctatcattaaatcgttttgtaaaaattcatgaacgtctaatctttcttcacccataatagttactccttgttgttagtatcgtatatgatggtaacgggtccgtcgttatttatttctacaagcatatcctccccgaattcaccctttttaacgtcaatgccttcttcttttattccatccataaaatattcataaagttcgtttgcttttttaggctccattgcttttgtaaagcttggtctgtttcctttttttgtgcttgcggcaagagtaaactgagatataacaagcatacttccgtttacttcttttattgataaattcattttaccttggttatcttcaaatatccttaaatttgatattttttttattaaataatcagcatcttcaaatgtatcattttcttctgcacaaaataaaacattaaaacctattccaatttcggaaataactttgttattaacgcttacttttgaattttttactctttgaacaacagctttcataaatttttacctctaagatataaaattcttcaaattttaacaacgagttattataccatttaagaatatgaaagtccacaaaataaaatttatttaattttaattttattttacgcttttaaggaattatactataaaatctttgtaaaacatatagtttaaacgcactttaataaaagcataatgcttgaaagaagccttgttttttggtatagttatcacaagtgaggatttttatgaaaaacattattttagcttcaaaatcaccgagaagaaaagaaattttaagtatgctaaattttccttttgatgttattgtttctgattgcgatgaagaatttgattcactattatccattgaagagaatataaaaaacgttgcatatcaaaaggctttaagcgtatttaaaaatcataatgacagtattgtaataggtgcggatacggtggtctatttagataacgaaatacttttaaaaccaaaagataaagatgatgcaaggaatatgttaacaaagctgtcaggtaagtctcattatgttataagcgggctttgtgttatgaataaagacaaagttgtaaagacttttacaaagacagttgttacatttaaaacaatgacaaatgaagaaatagaagaatacataaatacgtctgaaccgtacgataaagccggagggtatgccgtacaaggacttgcaagcaagtttatcaaagaaataaacggtgattactttaatgttgttgggctaagcataagtacactttatgatatattaaaagagttttaagatatgaaagatgataaaaatattattaatgaaatagaagaaaaaatgaatagagaaggagttgtcagtttaagtgatgaacagcttttatctttattaataaggaaaggtgattcaaccaaaagtgtgattgagttatcgaaaaatataataagaagatacggtagctccttaagcgatttagtgggtataaccaaagaagaattgattaaagataatcccgggatgacagatttaaaagcaacaactcttttatgttccattgaaatgggcgcaagaacttatttaaaaaaagaaaaagccaaatatattttttgtacccaagatgttttagatttgttaagttatgagatgtcgtttttaaacgaagaacattttaaggtaattcttcttaatacaaagaatatgattatagatagtattttaatttctgttggaacgataaatacatctttggttcatgtaagagaagtatttaaaaatgcaataaaaaagaatgcaaattctattatacttgtacataatcatccaagcgggaattctatgccatcaaatgaagataaagttttgacaaaaaggctttgtgaggcaggagagcttcttggaataaaggttttagaccatgtaataataggtaaagataattacttttcctttatggaagaaaatatgatataataatatattatttattctaaggttggagtaagatatgaacgaagattttgtaagtgtaattattcccgcagcaggcagaggaaccagaatggggaaaagtatcaataaacaatatatttcacttgataataaagctatacttacccatacaataatggcttttgataattgtccatatattgatgaaattcttgttgttgttgccgcaaatgaggaaaaattatttaaaaatacagttttaaaagaatataaaataaagaaaccatataaaatcgttgttggaggaagtacaaggcaagcttctgtatacaatgcagtaaaaaaagtagataaaaaatgtactattatttctgtacatgatggagcaagacctcttatatcaaacaaagaaataattaacactgttttaggtgcaaaaaaatttggaggctgtgtactaggggtacctgtaaaagaaacggtaaaacaagctgatgaaaagggttttgtttctgcaacagtagaaagaagtacactttataatataagaacaccacaggtttttaaagctgatattttaaaagcagcttttgaaaatgctgaagaaaaaggaatactgggaactgatgattcatacttggtagaacaatatggcttgaaagtaaagataatcaaaggttcttataataatataaaaataacaacaccggaagatttaatctatgctcaagagattttatccagcagaaaatagggggtaaaaatgaatataaacaaccaaaaaattgttgagttattttataagatgttaaaggttagagtttttgaagaaaaacttgccgatttatatgaacaaggaaaaatacatacgaatttatatttatccatagggcaagaagccgtaagcgcaggagctatggcagcaataaacggaaaagataaagtttttacttctcacagaaactttgctgcttcaatatgtcttgaaatggatatagaaaaaatgtttagagagataatgggagttgacggaggatatactgatggtatagcaggtcccggatatttcgcagatacagaatctgatatctatggagcttctgctcttcctgcaggaaatgtttctgttgcaactggtgttgcaatgggagaaaaaatacaccatacaaataatattgtagtatcttttataggagatggcgcagtaaatgaaggtgtattttctgaaagtgtaaatatggcttcaatgttcaaacttcctattatttatcttgttgaaaataatgcttatgcaaaaggacaaagttttgcaaaaacatcaacagtaaaagatattgcatctcgtggcagtagtttttcaattccgggaattattgttgacggaaataatgttcttgatatgtatgaagcaatgcttacagcggcaagttatgtaagaggagggaaaggacctattatcctcgaagctaaaacttatcgcttcagtggtcaccatttggcagataaagctttatacagaagttcaaaagaacttagagcatggcttgaaaaatgtcctataaagcaattaagtaattatatgcttaacaatatggtaggcgttgacgatgatcttcaaatgatgaaagacagcatttccaatgaaatggacagtatcataaataaaatattaagcgaaaaagaaattaaaaaagaagaaataaaagaaaaagaagaagaaaaaatatcaaagaaaactcaaattgaagaggaactaaaagctttactagaacaaaaggaatttttaaaacaagccgatacgtctgttatgatagaagaaccaaaacttaaatcttcaattcaatttgatgatgaagagttatttggtgatgaagaagaaataagagcaaatgataaagtgtttgaagaaataagacagcttaaaaatattttccctgaaagagatgattctcctaaagaagaaattaaggttgaagatatattaaaaaatggacatactcatactttaatatcaaatactgatggttttgcagatgttgattttagagacagcttaaagaaaaaagctgagaaaaatgcaaaatacgaagaggaagatattgtaacagaagaagagaaaaaatatattgctgacgccgaaactgttcttgataatatatttaaagaaatagacgaagaagaaaaaaaatatcaagatgaaaacagtgcaggacaagatgatgaactttataatattgtagatggatatgaagatgaggatatccaatatgtaaattcttcttatgatgatagtgaagattatgaaagccttagaacgcaacatgaaagcaattataatgaagaggtaatagaaaataaacaagaagaaccttttgatgaggaaaaagctttgcttgaatataatgttgacgatgaaataatcaatgaatacatgagaagagtaaatgacagtataaatcaaaaagaagaaattccatccaaaccttttagtatgcctgataatagtgatgataacataatagatataagtgacggagacagttcaaataatatctccaaacttcataacatgcttaaaatagatacagatgatgactctgaatttgatttctttggggaggataaataatgatagaattaacttttaaacaagctataaaaaatactcttctttacgaattaagaacaaacagaaatagtgtttttgtatctcaggatattggtgtttttgggggagaatacaaagttagtaagggatttgatgttcaaattccggaagaaagaattatagaagttccggtaagtgaaaatgcttatataggttcaagtgttggacttagtttaaatggatttaatgtaataacagaagttccgggatgtaaatttttacttagatctcttgatccaatcgtaaattatgcatcaaaacttcctgcaatgggaactaatataccgggaagtcttcttataagatgtcctattggttatagcggttatacgggtatacaagataatgaatctattgagtctgttctttcatattttcctggaataaaagttctttatccttcaaatccaaaagatgctattggaatgcttagaagtgcttttatggaacacgaacctgtaatattttttgaaaataaaaatctatatgatacaaaaggtgaaataagcgaaaccaaagaagaaaaaattcctttgggtaaagctaatattacaagagaaggaacagatataacagttattgcttacggcagtatggtaaaggaagcaatgaaagcaagcgatgttgcatatatgagtaatgtaaaagttgaagtgattgacttaagaacaataaaacctatcgattttgatacaattataaaatctgttaaaaagaccggtagggtgattattatatctgaaagttataagagctgttctgttggaagtgaaattgcagcaactcttgcagaaggagaagcttttgattatttagaagctccaatagtaagaatgtgcagtgatgataaattccttccttttaatccagataaagcaaaagaaattctcccaagttcaggaaaattattagaaaaaataatgcaattggttgaatactaattcagaaaggggtatacatatgacaaacttaggaaattcaaaacaaaaagcaagtcccgcaacaagaaagttagctaaagctttgggaattgatttatcagatatcgaaggaagcggcgaaaacggacgtattgaagctagtgatattgaaaaatatttaagagataaaaagaaagttgataatgaaatatctgatgatgtttttgtaaaaaaaatgaatgaagatgacgagttcaagattttggaacaaagaataaatatgataaacagtgaagaagatatagataactttgatgaagaatcgaacgctatatatacaaatacaaatacacaaaaaccttcaaaagaaatagacaatgcagattctgatataattcaatttatgataaaacatcaaaatgatatttatgatgatgagggagaagctccaaaagatataattgtaaattacgatcaaaattcaaatactataacaagtgaatatacaacacctgaagaaacaagagaagaaagagaagaaaaaagcgatagtattgaaaagatgaacagagacgaacaagctcagtattctccaataattgaagaagttgtttctaaagaatttgatgaggaaggtaaagaaattcctgttgttcctgttgaaaataatgtagttcatcaagttgttgttccttttgaagaagatcctgatgattatcctgatactgaaagagaaataaatgaaagttttggaagaagagtaataataacattaaatgatgacacaagcagttctgttgtaattaataaagaacctgtagatgttgaagaagaagatacaaaacaaaatcaagttgtaattgaaactcatacacataattctgtaagtatgggaataaaagctcatttgaatttagtaaaagaaatgttagcttcttactctgatttaagtgaaagaaaagtttttaatacaatagtaaaatctatcgtattttctcttgataaagtaaaaatagattcttttacaggaaaaataaaaatttgtaaattccataataatgaacttacagaaaagaaaattgaaggtgtaaatgaacttactgtaagtcaaatggataaaaatatggtagatattgaagatggagaagatattgattatattattacggatatgactcctttgaatattgattattattatcctaaagcttttgaacaaaaggttgatataacagtattaattaaagaagattatgtaaaagtatatataaatgcatgcgaagatttaatgagcagcatacaatgtgcaaagagggtttttaacaaaaaaaggggatagcgttcatacgatgcatacattaagtttttacataattaccctatttttaaaaacaaggcaatatttacatattcttatgattttgaaaaaggaatttttaaagaagaaatagagaaaaaacttaaagaaaataatatagatattaagctgtcatattcaaatgtaggcaaagaagtacataaattatttagatataacataaattttataaaaaaattaacggctaactttattacccttatgaaaactaccgcaagagatgaaaatgacattcttaatataaataattacaattcaaagcaggaagaacaaagagaaaaggcattttttaaagtagttctcccaatatannnnnnnnnnnnnnnnnnnnnnnnnnnnnnnnnnnnnnnnnnnnnnnnnnnnnnnnnnnnnnnnnnnnnnnnnnnnnnnnnnnnnnnaaacatattttaatagatgagtttcaggatatatcctattccagaatgtcacttataaatgaaatttataaaaaacacaactcacatatatttgccgtgggagatgattatcaaagtatattccgtttcactggaagtgatattaatattttttatgactttgaaaaagaatataatgcaaaaaaatatttcatagaaaaaaattatagatttgatagaaccattgcaaatgtaacaaacaaatttatattaaagaatccatatcaaattaaaaaaactcttaaaagcagcaaaataaacattcttccaattaattttgttacagcaaggaaaaaaagtgaattatacagagtatttttaaaagaaatatacaaacttcctaaaaacagcgaagttatgcttcttggcagatacaaaaaagatataattccttatgctcaaacaaacgaagtaaatataatacttcatgaaaataacgaaatatcggtaatacttgaaaaaagaaaagatttaaaaatcaaatttctaactgtacataaagcgaaaggtctggaatgtgattatgtatttatacttaatacatttaacagcttaatgggttttccatgtaatataaccgatgataaattaataaagatgttacttaaaaataaggaagattttccatatagcgaagaaagaagattattttatgtagcccttacaagagcaaaaaagaaaatatttttaatggtaaatcaaagcagtatgtctggttttgttaaagaaattatggaatacaaaaaagattcaaacatattcctataaaataatgatataataataaaaaaaggaggaacaacatgatttcaaaagaagcatttgaactattagataatcagctaccaaaaggagcttttcttacagtaaaaaataatgatgaagttaatacaatggtaataggctgggcaacagtcggtaaagtatggggcaaagacgtaatgacagtaatggtaagatattcaagacttacatatgatttaattaaaaacgcagaagactttacggtaagcgttccagctcttgatacaatgaaagaagaaattgcttttatgggaacaaaatcaggtagggattttgacaaatacaaagaaacaaacttacatttaaaagactcaaagaaagttgcatctccaattattgaagaagcaaaattacattttgaatgtaagataatttacaaacaagctatggatcctatgggcattgttgacaaagaaggaatagaagacagattctataaaggaaataatgattaccatgttatattctatgcaaatatagaagactgctatgaaaactaaaagagcatacttttgtaagttctttttattattctacttatagtcaaataatgctttattaaagctttttatttaatatatttttacaatttttattataaaaaacaaaaatttagttgaataaatttttcttatatgatatactttttaggctatgagcttaaatagcttttttattatgggtgttcctctgcttaaagatgtaagtaagaatgcttgaagatgaagggaggcacaaacaatggatttaattaaattagtagaaaacgaaaaccttaaatctgatatccctgaatttaacgttggtgatactgtaaaagttcacgttaaagtagtagaaggaaaaagagaaagaatccaggtttttgaaggtattgtgcttaaagaacaacacggtggagttcaaaaaacatttactgtaagaaaaatttcttatggcgttggtgtagaaagaactttcccaatacactcacctagaattgacaaaatcgaagttacaagaagaggtagtgtaagaagagctaaacttaactatcttagagatagagttggtaaagctgctaaagttaaagaaaaaagaaactaaaaaaagtcctataaggactttttttgttgctcttttttatttttcttttttaaaaaatgctatacccacacagtgaggacctgcatgagttcccactacagcaccaatattgctcgcaggcaaaatatcaatatctttaagttcatcaaaattatccaacatatatttttcaaaatgagaataagcttcttcatcatctatatgccccataaaaaatgctttgtctttatctattccatactctcttgctttatctataataaattgatatcctttttttcttcctcttaccttctttattggaacaacttctccacccgttatttcaattacaggcattatatttaaagtattaccaataaatgcagcactctttgaaagccttccgccaagaacaagatacttatagtcttcaattaatgcaagtaaagtactgtttcctttaatcctgtttatttcatcttctatttcttgcccgctaagccccttatctcttaacttagccgcttctaaaactaaattacaaagacttaaagtaacacatgttgaatcaataacatgaactctgctttttctgtcattatcaagagaatctcttacaacgactgcagaattgtaagaaccgcttaatttagaagataaagttattacaacaacatcttccccgttttcagtaaattgcaagaataaatctcttaattttcctacaggaatctgacttgttgtaggaagttctttacatgttgcaagtttgtcgaaaaactctctgtgattaatggttataccatcaatatattcctcttctccaaaataaatattaagaggatatacattaatattatattctttcatttgttcctttgttaaatcggcagtagaatccgttaaaatatttactttcattacatattctccatatagggtattaatataaaatatactattttaaacttttattgtcaatcattatagttatgttttaaaaatattgttaataacgaattttaattcccatcatttaaaaattataaaataaaaccgccatctacacttataacttctccggtaataaaagaagcctttttatcacaaagaaacaaaactgcatttgcaacgtcttcaggggttccaattctgtttataggagtttcttcaattaaagactccatatcttctttcgacaaatgattattcatttttgtatctataactccgggagcaatgacattaacatttataccacttggaccaacttcttttgcaagagccttgctcattcctataagagcagcttttgaagcagaataacatacttccatgcttgctccacttattccccacatggaagatatgtttattatatttcctctttttttattaatcatctcaggtaaaaaagcttttgtaagcataaaagcactttttacattaacatcaaaaacgttatcccattcctcacaggtagtctcatcaaaaaacttaacaagacttattcctgcattgtttactattatatcgacactgttaaaagaagaatacaccttttcttttatttttaatacatccctttctttcgataaatctcctttaagcatcaatactcttttatcagttaaagaaaattcatcttctaaagcttttttatttttgttatatagcaaaactatattataaccttcattataaaaagcttttgaaattgcaatcccaattcctccgcttgctccgcttataactactgttttgttattcattacgataatctttcttcaataagttttgcaagagatgttgcatcttctttaatttcactttggttttcaccttcaatcataactcttaccaaaggttctgtaccacttgttcttattaatactcttccgtttcctgcatatttatcttcaattgcttttatagcttctaaaatcacactgtctttttcataatcatgttttttatcattatcaacagttgcgttaattagtacttgtggataaatagaaacgtcttttgcaagctcatcaatatttttaccacattcttttacaactttacatacaagtaaagctgtggcaattccgtctcccgtagaatttatatctgaaagaataacatgtcctgattgttccccgcctatgttatatccttcattaagcattctttctacaacatatctgtcccctacacctgtttcacttattttaatgcctttcttttcaagtgcctttttaactcccagattactcataacagttaaaacaagagtatctttgtttagttttcctttttctttcatataacaacttaaaagatacattatcttatctccgtcaaaagcttgtcccttgctgtcaaccatgataactctatctccgtcaccgtcaaaagcaataccaaaatcagcattcttttctaaaacagttcttgataaattagcaatatgagttgaaccgcatttatcgtttatattaattccgtttggatcatttgcgataactttaatattcgctccaagtttttcaaacacttcttcacctactttatatgtagcaccatttgataaatccaaaacaatattaagtccacttaaagattttactcctatttttgataaaagatatttaatgtaaatttctccgggataagctatttttgtttctcttcctattctttctcctgaaatgcttctatctcttaccttttcaaaaatatatctttctatttcatcttcaacttcatcaggaagtttatgccctgttttactaaagaattttatgccattatattcatatggattgtgtgatgctgaaataacaataccgctatcggcattaaattctttaaccaatacagcaacggcaggtgttggaataactcccgcattaagtacgtttcctcctgcagacataattccgcttacaagacctgcataaatcatatctccagatattcttgtatccatacctactacaaatgtaggaggatttccattatcctttgtaagtttcattgttgctgcatatcctattttgtgagcaagttttgatgtaagctgagtattagcaacccctcttactccgtctgttccaaataatcttcccatattaacccccttagttttcgtttattgcttgagccgcttttatgccgtcgacagcactggaaagtataccgcctgcgtatcctgcaccttctcctacaggataaagcccttttatattttcactttctaaagttattttatctcttaaaattcttataggagatgaagttcttgtttcaactccggttattataccattatagaaggtattaaaaaatccatggaaataaccaaaagaatctttgattgatgatattaaattatcaggtagaagttcgtttaaatcacattcatttactccaggcaaataacttggtttaacatcaacactgccttttatatttaaaaaatcagttatcttcatataaggtgctttataatcttttccacccatttcaaaagcttttctttcaagcttttcttgaaattcaactccagcaaaaagcccgcttccatagtcgctttcacttacatttactactattgcagaatttgtatttatcatatttctgcttctgaaactcattccgtttgtaacaacttgaccttttgaacttgcacctgcaattaccacacctccgggacagttgcaaaaagagtatattcctttttttgtatttttatcatgaaatgtaagattataacttcctgcacccagttcactatgtccggaataagaagcataacaacacttatctatgtcttctcttaaatgctctaccctaaatcctacggcaaaaggcttattctccatattaacattatgcttttcaagcattttaaaagtatctcttgcaccattgcctataccaagaacaacagtatccgataaatattcatctttttcgtttataataacgccttttatttcattctgctctataattaaatcagtaacggtagaattaaaataaaattttccaccgtaatattctattaaagcctttaaatcatctacaattattcttaatttgtctgtaccaagatgaggtttattaagatatcttatatcttttggtgcaccacattttataaatgtatctaaaacttcatattttaaatttccttttattcttgagtttattttcccatctgaaaaagttccagcccctccaagtccgaattgaacattggaattttcatttaatactccgttatcaaagaaatttttaactgttttaactctgttttttatatcctctcccctttcaaaaacaaggggttcatatcccatttttgcaagatataaagcggcaaacaaaccgcttggaccactgcctactactatcggtttaatatttttcttctttgttaaatccagtttaggaatacttttttctttatacaagcttactttataccctacattatgaggttttatgggataatccaatataacactgtaaacataatatattccatcactatgtctttttcttgcatctaaagactttcttaaaattttaaaatgttttactttttgttcagttaatctaagcctgtttattatagcttctctttcaccaacaccggataaattatctatatttatttttatattttctattaaatattttctcactttaatattattcctttgttatttttaccaaaacactgttttggcttacacttcttatacttacaccttcaggtaacccctgtgtacttatctttatatcaacattatgttccccttcttttaatcctgataaatcaactactcctataagatttttttctgttatagaacttaaatacttctcttctcctgctaataaaacacttatattatcatctaaaacttctgcagtaagatcacttcctaaattttcaaatgtaaatgaatttatatatacggttttttgattttgtttgtctataaacacattaacatcaatgatatctcttgtatttacaatatgcactccctgaggaatgtccaatttaacatttctatcaaaagattcactaaccccatccaatgaaatactttcagtatttatttcgtttatagtatttaaaacatcatctgttgcagaaatagttacggttgttgtgcttggttttatagacgtaattttatatccatccataacactacctgatgtttttacatttataggaacattcttaatttttcctatttcaatatttacccttgttgttgcaggagatagtgttacatctgctattttcttattattttcatcaactgcatacaatgttgcagttgatgaaaaatcatcgcttttatttgttacatcaacattccccattatagcttcaactttatcaacactatcggaaggtccgcttatattaacatcttctacttctggagaaagagataacacactatagccctccctaacttccccggttgactttataataggcacacttaaacttttgttaccttttttatcaactgtgactttaattgtattaggattttgatcaactatagtaacatcatttggaacaccttttatattaatatttagtgtataagtcccttcgcttgaaatgtcttttaaatctacacttgcctgtatatttttgttatcaaggctttttactaaagagccttttccataaactttcatactgtctatattatcagttgaaacagaaataataaaatcattttgctctagtactgaagtatttgtaagaacaataggtatatcttcgattttactgtataccatgttgtcactatcattatttgcatatacccataaaagaagagctagcaaaaaagatatcaataaagttactattttattattattctttcccattgctaccttttctccttaatatttttgatttagaatttttatgagcaggttcttctactaaaatttcagtaagaattcttctaatacctctttcccccacgaaccttgataatttcccattaatagcataagaaataacacctgtttcttcagataccattaatgaaacacagtcagaatgttcgcttacaccaattccggcacgatgtcttgttcctatacttgttgaaagctgtttgttttgagaaagaggaagcagacatgccgcagcccttattcttaaagtttctctgtttattattacagcaccatcatgaagaggcgtagcatactgaaaaatattatttataagctctgtacttaataaactatcaagttttaccccggtttctacaacatcatcaagaggaacctgtctttctataacaacaagaagtcctgtttttgtctttgataaatcacttatactttgaacaatttgatccaccgcaacagaaggagaatctaaatctttgtcaacaaaaatatcttttatgttttttacatttgttttaccgattgtttcaagcatttttctaagctctggctgaaacataataagcaaagctaaaaatcctacggttattatatttttaaaaacaaagtttacggtcacaagccctaaccaatcactgacctgagtgataaccaaaattataattatcccctttgcaacctgttctgcctgagttccttttataagtcttataattgcatatataataaatgtcattataagaatatcaacggcagataatatgctaaaggactcaaaaatttgagtaaacaacgatgttatctgagacattatcattaccttccctaagtaaatttatttttatattattgacttatattatttttttaatattttcaatagtgaaaacacaataatattatacattattttattaaaattgtttaaatttaatgaaatattaatatataaattaatttatataagaattattaaaagtaaaataaactacattctatatacattttataattatgtattaaaaaaactcaatataaaaaaggcacataaagtgccttttattatttcaattcaaataaatctaataaatcatctgttatattatcaagtccttgctttattacattagttaatgagttgtaatgctctactttatcagaaaaataaacattttttacttgaggatatttttctttaatcaaagtgctaattttagcctttttttcatctgataaacttgaagaacctgtttttgtttttaccgcacagtatgctttattcccgattattgcaatttttacgtcttctattccggaaattttctttacagaagtataaacaccgtcgccttcctgtttatatttatatgattcggaagaattataatatcctgtattgttgttagtatactgtctgtacattccgttataatcaaattgatatggattgactccgttattattttttactccatttgaagagtcactatcagttaaatcttcagttaaatcttcagcaccctttttcacatcatctcctatattttctacttcatctttaacatcatttgctgcattattcatttgattttttacagcattatccgtatttgaatttccacatccaacaaaagaagttaacataaaagcagaaataatcatagctattaaagtttttttattcattaaaatcctcctttctgtattagtatttagaaagaagaattttatatgctggtaataaattgattaaaaagtattattttctattaaagcagacaaattttccctgtatttacacttatatacattaaccagtatccaaaaccgtcataaaccgtaggttcataataaataaatcccgttgagcccataaaaggctgagtattgtctatttttgagccaagcacaccataaatataatattttacttcttcatctttaaaaaactttccaaaaatccaacttggaagaattgcattttctaattttttatttttaaatcccatataaggataaagaatcggcataacaaaaccattataaataatattaatatcatttatattttcttcatattcatccattatgtagaacttataattactatctaaatcagtaaaattttctaatgaaaaattttttaaaacatcatctattaatatattatttgcattaattattttttttattttatttttatcttcttcttcatctttatcttgaaattcaaattcttgatttatttctttttcatcatttatatttttattattttctttttcatttttatttgaaaaaatatcaaataaatcttccaaaatatccagctgttcttctttttctaaaatagaatttctatcttccttagaatcttcctcttccttttcattttctggttttattttattatttatatttaaatccattatttcattagaataacagaattacgaattaagaaaaatgtatcagaatataaaatgagtactgatttagggcatagtaaaggatatattcaaagtattgcttctggtagaacattaccttctatgacagaatttttatatatttgtgattatttagaggttactccaaaacttttttttaatgaagatgttaaagagcctattttgtataatgagattagtaaaaacttattaattatgaatgaagatgatttaaaaataatcttagatatatgtaaaagattaaataataatgtataaaattaaaaaaataaccgcaaaattgtggttatttttttaatttcttgagtctaataatataaattttatggtataaatttcattttaaagagaaaaatatttacaaaaaggaggagtaaatattttggaaaatacaaaaattaatgatatttatgccagagagattttggattcaaggtctaatcctaccgttgaagttgatgtagttcttgaagatggttctattggcagggctgctgttccatcaggtgcttcaacgggtgagtttgaggctgttgagcttagagataaagatgaaaatagatatgtaggcaacggagtattaaaagcggtagaaaatgtaaatcattatattaaagctcatttaataggaatgaatgctgcttatcaagatgatattgacgctgcattatgtaaaatagatggtagtaagaataaaggaaatattggtgcaaatgcaattttaggcgtttctcttgcttgtgccgatgccgtaagcaaatctttaaaacttcctttatatagttatatagggcagttatctaataatgatgcgacattacttccggttcctatgatgaatattttaaacggtggaaaacacgcaaataacaatttagatgttcaagaatttatgatacttcctcatagtacagatacttttaaagatgctttaagaatgggcagtgaaatctatcacaaattaagagatattttaattgaaaagatgatgagtgtttccgttggtgatgaaggaggatttgcccctgatgtagatagtgcggaagaggctattatgcttataatgaaagctattgaaaatgcaggatataaaccgggagatgatgtatatatagctcttgatatggcaagcagtgagctttatgataaaaagattgattcgtatttttatgaaataaaagaacgaaaatacggcgagatgatagcatattatgaaaaacttaccagtaaatatcctatcatatctattgaagacggtatatcggaagatgattttgaaagctggaaattcttaagtgaaagacttaataacagcattcagcttgttggagatgatttgtttgtaaccaataaagaaagacttaaaaaaggtattgatatgggggttgcaaactctatattaataaaattaaatcaaataggaacattaagcgaaacgttagacactatgaatttagcaagaaaaaataattatacaacggttgtatctcataggtcaggtgaaacggaagatacttttattgctgatttggctgttggttttaacgcaggacaaataaaaacaggagcaccttgcagaagtgaaagagttgctaaatataacagacttttaagaattgaagaagagctaaaggataaggcaagatatatcggtaaggatgtttttactaatataagattaaaataaaaaaagcagttgtaactgctttttttacttctctaaatagggttatattatagttcttgtaggttgatacaaaatattttacttgcatatatttcccaaaatgaattttaggatggttttacctaggttttggtaaattaattaattcttcccaattatatcttttaagatataaaaatgtatatttgaaacactgagaggagatttaataaaaaacaaatatctaaaaaagtatttatatttagagcattattagttatagggtcctttattataaaattagttatggtatattgctataatataacttcttaaatacttttgtgaaacttattataaagggtaagtgtgaaataagtttgttaaaatgtgaatatttgattatattgtatctaaaaaataagtggtaaaaataaaaaataaaatgaacttaatatgaaaaaagaatacgcttagcgtattcttctatccttttaaaccatcggcttgtctttgcatattttctactactatgtcgtgtatgtcgccaagagagttgcaatattttaatacatcccatggttcatttgtatgaaagtgtatttttattaatttttcatctccgactgcaagcagacagtctcctttaaagttatttgttatataatcatggatttcatcttcgtctaaattttctccggcaataagaagctgtgtatcaaatttgaattctatcataaattttcctccttttatttaagggcttttataatttgtttagtcctattttatattttgattatataatataaattttatatttacaataatctaaaaaagagttatacttatttagtaatgaatttatttattggtgtaatcctccaattattcttataaataaatttttatagaaaattgaatattgaagaatttatcttcagggcaaggtgtaattcctgaccgccagtaaagtctgggagcgaaagctgatatggtgtgattccataaccgacggtatagtccggatgaaagaagatatgataattaatgccctgttattttagtataacaggcattttttaaattcacctcatatctataataaggagaataatggaaaacttaacaacaaatcaaacaacaaactcaaaaatcagtacaagggtaatggtatgtacggctatgttagctgctgtatcattcttactcgcatttttagaagtaccaatgcttttatcaccatcttttgcaagaatggatttatctgaccttcctgcattaatcggtgcatttgcttttggacctatggctggtgttgtaattgaactaattaaaaacggacttcaagtattttcaacacaaacagccggaataggggaacttgcaaattttgcaatgggtgcttcttttgtttttactgcaggattaatttacaaaagaaataaaacaaagaaaactgctttaattgcttgtattattgcaagtgtagtaatgggagtagttgcaggattacttaattattttgttttacttcctatgtatagtgcatttatgccaattgatcaggttattgcttcttttggagaaataatacctttcattcagactaaatttgaagtaattttatttagtgcaattcctgcaaatattattaaaggtctgattatttcattatttgctatgcttatttataaaggggtaagtcctatattaaaaggagaaaagtaaaaaatggaaaaagccaaagattatttatcatttttggtagatgaagttcattctacggtttttgcaacagtagataaaaacggagaacctgaaacgagcattatagatttaatgctttatgatgaagacagtgtttatttcttaacagcaaaagggaagcctttttatgatagacttatggataaaaaggtagtttccatatctgcaatgaaaggaatggatacaatgtctacaaaagccattatgatgaaagctaaagtaatgaatataggtagagataaactcgatgaaatatttgagaaaaatacttatatgaatgaaatttatacaagtgaagaaagtaaaatggctcttgaagtattcaaggtatacgatatggagggcgaatatcttgatatgtcacaacaacccattttaagaaaaacattttcaattggagggggaaatgttagaaaagcaagttatcatataaatggagattgtatagggtgtgggaagtgttttgaggtatgttcctttaaagcgataaagaaaggaaatccttataaaataattgataactattgttttgaatgtggaaattgttatagtatttgtcctgtaaatgctgttgataaaaataattaggacttatgaatttttaaattcaattaatattacatagttaaaataaaaaagacacttaagtgtcttttttattttgataaaagtttcttttcaattttatttttattttttaaataatataaaatccctgtaatatcggcaagcgcccaaccaataggcacgctcatccatataccttttactcctataaatgaaatagaagataaagtataggcaaggaagactctgcttccaagagaaataattgttaaaataacggacattaaaggtttttctattgctctgtaaataccataaagtaggaacaaacatcctattcctatataaaaagcaccttcaattcttaagtattctattcctgcatttataattgctgtttcatttgcatttacaaatatcatcattaattgttttgcaaatacaaaaactataaaggaaataattaaacagaaaatgcttgataaagcaattgcactttttattcctttttttattctctcagtttcttttgctccgtaattttgagctataaatgttgaaaatgcattaccgaaatcttgaaccggcatataagcaaaggagtctatttttacagcagcggcaaaggctgccattattgtagcaccaaaagaattaactaaaccttgtaccattaaaattccaaaattcattatagattgttgtatacaagttaagaaggaaaacttaaatatttcatttaaaatatttttattccatttcatatatttctttttgaatctaaaatcagggaatttaaaaagtgtatatattgttattccaagacctgagatgtactgagaaaatactgtggctatggctgctccttctactcccatatttagagttattacaaagaataaatcaagtataatattaataattgcagatatcccaagaaatacgagaggaatgattgaatttcctactgctctaagtacacaagcataatagttgtaaaggaaagttgccgttattccaaagaaaataataaaagtataacttttcattatcataaaaatattttccggaatatttaaaaaatatagtatttgatcaataaaaatgaaaactaaaatatttaatataattgttattaaaagaattaaggaaaaagaaacaaataaactttcttttaatttttcttcatttttttctccatatcttatggaaaaaactgcaccgctacccatacataaacccaaaagaattgatgtaataaaaaccattaatgtataggcagaacctactgccgcaagagcattttttccgataaattttcctacaattaatgtatctgctatgttatatagttgttgcaaaagatttccaattatcatcggaaaagcaaacaataatattttttttgtgatgtttccttttgttaaatcaagctgcatgttttctgccttttgtttttttttaatgatatatctatattgtaaatttgtcaatttgatgtattattgtattaataaaatattgtttaaatacagtgttttaatggttgtataattgactttgataacatattttgatatacttttttgttaggtaaaggtatttttttaccgtgataaaaggaggaaataacaatgataaaagtaacatttccggatggaaacattaaagaatttgaaaacggtgtaagtgtattagatgtagctgaaagtatttctcctgcacttaaaagagatgttttatgcgctaaagtaaatgatgagattgtggatataagaaccactttagataaagacgttagcattgtattttataaatttgatgatttagacggcaaaaaagcattttggcatactacaagccatatcttagctcaagcagttaaaagaatatatggcgataaagtaaaacttgcaattggaccaagtatagataatggtttctattatgatttcgatacagaaataccgcttcttgaaagtgatcttgaaaaaatagaagcagaaatgaaaaaaatcgtaaaagaaaatatttcaattgaaaaatacgttttaccaagacaagaagctattgattttgaaaaggaacaaaaagaagattataaagttgaactaattgaagatttacctgaagacagcattatatctttctataaacaaggagactttacagacctttgtgcaggtcctcatttacttaatacaaaacctgtaaaagcaattaaacttttatctattacaggtgcttactggagaggggacagcaacaaaaagatgcttcaaagaatttacggtatttctttccctaaagcaaaaatgcttgaagaatatttagaaatgcttgaagaagcaaagaaaagagatcatagaaaaatcggtaaagatatggacttattcatgatttgtgaagaaggtccgggatttcctttcttccttccaaaaggaatggttataagaaatgaacttgaaaacttctggagaaaagaacatagaaaaagaggatatgaagaaattaaaactcctcttatcttaaatgaagatttatggcatacatcaggtcactgggatcattataaagacaatatgtactttactcaaattgacggaaacgattatgcaataaaaccaatgaactgccctggttcaatgcttgtatataaaagaaaaatgtattcatacagagatttacctttaagaataggtgaacttggacaagtacatcgtcatgaactttcaggagcacttcacggacttatgagagttagaacatttactcaagatgatgctcatatctttatgttacctgaacaaattaaagatgaagttattggcgtaattgattttattgattatgtatataatatgtttggatttaagtatcatgtagaattatctacacgtccagatgattcaatgggttctgatgaagattggaacatggcaacagaagctttaagagaagctatggaagcaaaaggaatggattatgttgtaaatgaaggagatggtgcattctatggaccaaaacttgacttccacttggaagactgtcttggaagaacatggcaatgtggtacaatccaacttgatttccaaatgcctcaaagatttgaccttacatatgtaggtcatgatggggaaaaacacagacctgtaatgattcacagagtaatcttcggttcaattgaaagatttattggtatcttaacagaacactttgcaggtgcattcccactttggttagctcctgttcaagttaaattaattcctattacagacagaaaccttgaatatgtaaaaggaattaaagataaattggaagaaaaaggcattagatgtgaaattgatgatagaagcgaaaaaatgggatataaaatcagagaagctcaacttgaaaaagttccttatatgttaattgcaggagatagagatatggaaggtaacgttgtttctgttcgtgcaagaaaagatggtgaaaatttaggagcaatgagcgttgatgaatttattgaaaaagctttaaatgaaataaatacaaaagcactttaaaaaaaacacccttttgggtgtttttttaattaaaatatttaccgtttggtttattatacttatattttttatagtgcttatgacatattatgtaatataaaatatatccgattacagcgcttattgtattaaatatcacatcatcaatatcagcaacacggcttactaaaaagaaaaattgcattatctcaataaatagtgttataaaaaatgcactttttacagttcttttaaaagttattcttcctggaaaagttaaaggaagtaaaaatccgtaaggaagtaacaacccaatattaccaaataaattgatgaaagctatcatggaaagctttcctccatttataagttcagtatattgtaaactttgccagtagtttttaatacttagaaaaggaactaagttataatgttgttcatatgtatattctccaacataaggaactagcgtcattgaaaatacaataagcagatatattgataaaattaaaaagcaaagccaatttacttttttgttttttcctgtcaaaattttacctcttttctaaaaaatgctatttaatgatacaataaagaaaagcaaaaaacaattaatatgaaaaagtttaattttttcttaataaacttcattgtaaattaaagatatgtttttactacattgctatttatattttttagatgtataatatttaagatttcaaattaatggagaataaagatatgagctttcaaataataagcgatggtgcttgtgatttacctaaaagttatgtggaagaaaatgatataaaacttgttcctttttatgtttcatttggagatgaagaattacacaaagagggtagttttataactgttgaagagttttatactaaaatggttgaaaaccctacggttttcccaaaaacatctcttccaagcgttaacgactatatagatgtatttactccttttgtagaaaagaatattcctatattatgcatttgtacagatttacaattaagcggttcttttaatagtgcgagaatggcaaaagaagttttagaggataaatatgatagtgctaaaataaaagtaataaattcaattaatataacagcttcgcaggcagtttttgtaggtgaagcaataagaatgagagataatggcattgaatttgaagattgttatgaaagacttgaaaaacttaaagaatatggaagaattcattttacggtaggaagtattgattatcttaaacatggaggaagaataggtaaacttgcgggatttgctgccggtgcacttggtttgaaacctcttattgagcttaaatatggagaggtttgttcagcaggtgtagcaagaagcagaaaaaaatctattaaacaagttttggattatacaaaaaaattctttgaacgtaaaaatgaaaatcctgatgattatgttttttgtgtaggttatggatacagtaaagaagagggagaagaatatagacttaaacttcataaatctttacaagaatattctaatgttaaattagaagaaatacatatgatacaaataggagcaacaattggtgttcatacaggtccttatgctctaggacatggatttataaagaaatatgataaatagtattcctaagcgagtttatattaatataagctcgcttttctttttgtatggtataatatgtaaaattaattttaaattgaggtagatatgaataatataatttccatttttattgtattaatattatttttaatatgtttaacaataagtattttgcagctaagttgtaaaggtccgttgttaaataacgcttttctttttgcttcaaagagggaaagagaaaatatgaataaaaagcctcattatagacaaacaggaatagtttttttattttatcagcaattttcttatgtcttttaattaatattatatttaaaattaagattttcgattatgttatatggtgtttaatattatgtacgatactgtatgctttggtatcttcaataaaattatataagtaaagttaaattttctcttgactctaacgttaggtaatagtgtattttaaatttggaggtaagatatgaagttaactgttggtgaagtttctaaattatttgatattagtgtgcgcacacttcattattatgatgaaataaacttattaaacccaagtgagaaaaaagagaacggatatagatattatacagatgaagatttggtattgcttcaagaaattattttttataaagatcttatgttacctctaaaagatataaaatatattttgaaacaagaaaaaagagataaggttgatatcttaaataaacataaaaaaattcttaatgttttacaaaggttttttgtttggttttgtaataacgttttttatatcttcttatggttttaaaggaattttatttttaatttgtgttttgataattccaaatataattaaaaattctgcactgatgtttgcttttgtgatgtcttcttgttttaaaagttcaattcaaaaaaataataaaaataaatatggtaaagtgagaaattcctctttttatcttagatatacaatatatatagtaatagcttttttatttaatgttatggggatatgttttgaaagttatattgctccgatgcttatggtattattttcttcttcttttttataataacattaatatttatattttactttaataaatattaaaagggaggagaaaattatgttaaaaagaataagttctatagtattaatatttgcttttttgtttaatattatgcctatttttgtaaaaggggcagaagaggaaaaagtagatttgaacataaaaagtaaggctgtagttttaatggattcgtcaagcggaaaggttttgtatcaaaaaaacatgaataagaaacttcctttggcaagcgttacaaaagttatgacgatactattgatattagaagccattgataataaaaccatcaatatgtccgatatggttacaatatcagattacgcaagtaacatgggagggagtcagctttatcttgaacaaggagagatgcgaagtgttgaagatcttttgaatgcaattataattgaaagtgcaaacgacgcttgtgctgcaatgggagaatttataggggggagcattgagaaatttgttcttatgatgaatgaaaaagcaaagagtctcggaatgaaaaatactcattttgtaaattcaaatgggcttcccgtggataatcactattcaagtgcttatgatattgcattaatgacaaaagaagtgtgtaagtatcctgatgtttttaaaataagtgccacttggcagaaaaccataaaaataggtaaaaataatgataaagagagacttcttaataatacaaataaacttttaaaaatgaatgataatgttgatgggttaaaaacagggtatacagctgatgcgggacactgtatttctgctacgggtaaaaaaggagatcttcgtcttattgctgttattttaaatgctcccgattcaaaaacaagatttgaagaagcaaacaagcttttaaactatggttttagcaattacaaaggaacaaatattgtaactaagggaggagagtttggagaaattaaaataaacaaaggttatgaggataatgttaaggtagttgcaaaggataattttacggttttaagcggtaaaaatgaaaatgaaaaatatacaaccgatataaaattagatggtatcgttatgaatgcacctgtaaaagaaggtcaaaaagtaggggtgataaatataaaagaaggaagtgagtttataggaagcgtggatcttgttatagaaaaaaatgttgaaaaagtaaacatgataacatatgtgttaaatatgtttaaagaatttatagttatatagtttttatattttataacataaatttatcaaaaataaaatcccgaaatatatcgggattttttatgttagtttaattttaaattttttgaatgtttgtatattccctttatagcctgttcgttattgtctgtttgtacacatccaagtgcgtttttaggtttaaaacttccgtggaaatcacttccgcaagtgtaaaataaattattttctattgcataatttttgtatttttcactttgttcatttgtatgtgatgtataatatgcttcaacaccatcaattccatattctttaagctcatcaagtatatgtatttcatcttttatatcgactccaggatgagctattacacaggctccacctgcattttttataacttttattaaatctttactacttggcatataagtaggggcataaagttctttgcctactccgaaagcttctctggaaagagttattatgctttcaatatttggctgtaatccatgtattaatcggtggtttctgttttcttcttcaattaatatagcatgaatatatgctgataaaagaggtatatcgcctgttgcataatcaaaaacctctttttcatttatttttagtcctttttctctaattaaatcaatttgtttttgtataccgtcttttcttccttgccatattttatctatttcttcatttaaagctttatcttctacatctattccatatccaagcatatgaagaagtttaccattgtgtgagacaaatatttccgttgcaggtataacggttatgtctttgttttttgcgtattctaaagctttttttacgtttgctatgctttcatggtctgctattgcaatatatttaagtccttcttcaattgccatatcaattattttttcgacttctacttcaccatcagaacttgcgtttgaatggatgtgtaaatctattttcataataattccccttccaaatgtgtttggttttgacctgttatttttacatttactattttattaaatatgtctttttcgcttttaacttcaacatatatataattttcactgtaaccttcgtaaatattatcgctaagtttcttttcaattaatactttttgggtgcttcctttcatattttctaaaaattcatgtctttttttaagcattatttcttttaattcttttgctcttttactttttgtttcttttgtgttttggtttttcattgtactggcaggtgttccatgttttggtgaaaatgggaagatatgaatatatgaaaatccaatttcttctgcgaatttttttgttgtttcaaaatcttcatcattttcatttgggaaaccaactataatatctgttgttattccgggattatcgaaatactttcttacttttgttactatgtcaaagtattctttagtgttgtaatgtctgttcatttccttcaatgttttatcacatccgctttgaagagaaatatggaaatgaggacagaaagatttaagtttgcttaatctttctagaaaattatcgcttaataatttaggttccagtgacccaagtcttattctgtcaacctggttttggttatcaattatttcaagtaattctataaggttttctcctgtgtctgctttatatgatgcaatgtggatacctgtgattacaacttccctatatcctcttttgcttagttcttcaatttgatttaagactttttcaactgatgcattttttaatacgcctcttgcgtaggggataatgcagtaagaacaaaacatattgcatccgtcttgaacttttataaaagctctgcttttgccttcatatgttgtaattcctactttatcaaaatctttactgtcttcttctatgttatatactttatttttacttaatttgaattcattaatataatctataattttttctcttttatgggttccgcatacgatatccgcactttctactttttgtgcttcttcaaagttactttgagcaaagcatcctgttaatactgttatggcatcttcgttttggtgctttaatcttctaacaatttgtttgctttttctttcgctttcgtttgttaccgcacaggtatttataacatatacatcggctttttcatgagcatcaactatctcgtatccgttttctttgaataattctatcattgcttgtgtatcgtaactatttactctgcaacccagagtgtaaaatgctgctttcaaaatgtatctcctttttttctgtttgttttattatatcacaaattaaaatataatgcatttgtaaaatgtattacaaatgtaacaatttaattaaactttacattacaaaagtattaaaaattattgactataaaaaaaatggtggtataatataggtaatgataacgaattaataaaggagatttttaaaatgagcaaaatgaaaagagccgttgtttacggaccagaagatttgagaattgaagaaattgatattcctgttcctggtcctggtgatgtggtaatcaaaaatgaaatatcgctaacttgcggtactgacgtaaaaagttataaaagaggatatcctcttatgacacctcctttccctttgggacatgaatcaagcggaactgtttatgctgtaggagaaaatgtaacaaaattcaaagtaggagatagagttgtttctcataactcagctccatgtaatgaatgttatttttgtaaaaaaggacttcactcaatgtgtgaagatttaattataaacaacaaaaataacagtgcctttgctcaatacatattgattccggaaagaattgtaaatcaaaatatgttccatattcctgatgatatgagttatagacaagcagcattattggaaccattctcttgtgctgtatatggaacagcaaatgttcctgtagaacaaggtgattatgttgttgttaacggatgtggaccaataggtttaatgtttgtaagattattatatttgaaaggtgcaagagttatagcttgtgatatgagtgaaaatagacttgaaatggctaaaaaacttggtgcatttgatattgtagatttaaacaaagttgatgatcaaatacaagcagtaaaagatttaacacctgataagagaggtgttgacgtggctgttgaagcaacaggacttgcaaaagtttgggaacttgcaattcaaatggcaagacctggcggatttgttctttgcttcggtggtacaaaagcaggagatacaataacagttgatacaaaattacttcattacagccaaattacaattaaaggcgttttccatacaacacctttatatgtaaatcaagcatttgagcttttgaaaatgcatgttattgacgaaaaagattttgttcaaaacgaatataaacttgatgatttggaaaaagctcttattgaacattctgaaggtaaagttattaaaaactttattacatacaattaaagtctatttgttttcttcaaagcaggtcattttatatgacctgcttcctattgcatttttttctttttataaaatttctccaatgtttctatagattttttatggtgtgcatgtacggtttgataggttattgataaatcttctgaaattttactccatgtttcataatttaaataatgttttttcattataagtttatcaagttcactttcaagagaatttataatattgtttacgtccattttatgtttatataatgtatttatttcctttataagctgttgtttatataaaattaaattaattatgctttctgtctttttgtcttcgtttttttctgtttttattccactttcatttatatatgaagaaatcctttctatgtacatttcacactctcttatttgatttgtggtatattctattttttcgttcataagatatggttttgataatttttctttaatattcatttttccacctttaatttaattttatttaaaaaggacttaataaatatgttttatcaagtccttaattttttcattataatgttagcataaaggagatataaaaatatataaatttgtcgaaaaagtttaaaggttttattatttaaaatatttttttcttttctttgtcttcttgaaccattcttaatacttctccgaaacgttgaaaatgaacgatttctctttctcttaagaattttaaagtgtttattagaagagggtcatctgtcatttttattaagttttcataggttattcttgctttttgttccgcagccatattttcatacatatctacttctggatctccttttgagcctatataacttgcagtccatggcacaccgtctacattaacatagaaaggattgcatccatgttctatgttgtatcctccaagaccgctgtttataagctcgtctttggttgctccctcaacgagttttgaaaaaatagttcctatcatttcaagatgtccaagttcttcgcttcctatatctgtaagtgtggcggtaccttctttaagcggcatataaaacctttgtgttaaatatcttaaagacgcaccaagttcaccgtcaggtccgccgtattgtgttaatacgttttttgccattctcaaatcttttcccgaaactgtaacgggatgttgcaacatttttttataaatccacattattcattatcctcccagttcatgttttgagcggcccaaggaccttctatatatttccaaaatccctcactgctacctgtattgtcaatagggttattgaatttttcataagcttcgtttacttcttttaatttctttgaatattcgttgtgtctttttagtacatccatgtcccctggatgtgtatttaaataaagagcggtatcttgagttgcaaaagtatatatttttattttattgtaaatttcttccatgctcatattatttatattttcgttattatttgttccgtctgctccgctgcatccgtgtcccatatctatttgcatactgtatcacttccttttaaatttgtgttaaatggtgaatataaagcttcaaacattgttccttttttcattaaaccttcttgtgcatcatacatatcgctgtttaattgaaatggcacatatgcatttgcaacttttggaattataggcatataaggaaccattggtttgtaatttctttcattcaattttaaatcctcccgataaatttgatttcaatataatatattcatttatttttttattgtgataaattaaatttaattgtcgcaattttttgtaaatttttatgttgataatgcttttaaatgggtttataatattttttaacgtataggaggaaaaatggaaagtaatattacatttgatgaagcctttgaaatattaaaaaaatacaataaagatatttttcatataagacatgcaattacggtatcttcggttatggggtggtactgtgataaattaggtatagaagatgaaaaaaattactgggaaatcgtaggacttcttcatgatgttgattttgaattatatccaaatgaacattgtaaaaaggccgttagtatattaaaagaagaaaacgtaaatgatgatataatacatagtgtttgttctcacggttatggaatatgctgtgatatagagcccacagataaaatggaaaaagttttgtttgcaatagatgagcttaccgggataataaatgctgctgctttaatgcgtccttcaaaaagtacaaaagatatgccccttaagagcttaaagaaaaaatttaaaagcagaggttttgctgcagggtgtgacagagatgttatacaaaaaggtgcagaaatgatgggtgttgaattaaatgaacttttaagtgacactttggaagctatgaaagcaaatgaagacagaataaatgaatttatggaaaattttgaaaaaaatttataaaagagaggtaataatatgaaagtagtatcaacaaaaaaggctcctgccgcaataggaccatattcacaaggaattatagtaaatggcatgttatatgcatctggtcaagttcctatcattcctgaaagcggagaaataatggaaggagatattaaggttcaagctaaaagagtttgtgaaaatattggtgaaattttaaaagaagcaggaagtgatttttctaaagtagtaaaaactacttgtttcttaagtgatattaatgactttaatgatttcaacgaagtatacagcgaatattttgtaagcaaacctgctcgttcatgtgtagaagtaagcaagcttccaaaagatgttttagttgaggttgaaataatagctttagtttaaaaggatgattctttcatccttttttattatttatatgataaaagtttataatatgtggtatcataattttaatgaggtgataggatgtattatagagtttctaatgtacttgaacaaatagacagtatagaaaatttatctgaaagtgaagatgttttagttgttttaacccttgaagagtggaaagaaacatgtaaacaaaatgccatatatacttattatatagattttgaaaatattagtttttcaaagtctgaagtatataaagatataatagcgggaacattttttattcctaaaaagggagaagaatgtttaaatggtaagtttgggtattatctaaaaaaacataggatttattttattgataatgataatatagttcttccaattattgaaaaaataagtaaacaaagacagtggaaaaatccatcaatagctcattttttatatgattttttggatattttaattagtgaagatttaaattacttagagcattttgaaaagaatataaataaccttgaggataaagttcttgacggcgatttaagaaattttaattatcttattgtttctatgaaaaggcagcttttagtccttaataattattacgatcaacttatagatatgggacttgtttttgaagaacatgaagaggatatattcaataattcttataaaggactttttaaaatttttacgaataaagtcagcaggctaaactctaaagttgatacattaatggagtataccagacatcttagagatttatatcaagctcaagctgatatcaggcaaaacaagacaatgcagactttaacagttattacggctgtgttttctccacttacgttaattgtagggtggtatgggatgaattttaaatatatgccggaacttacatggaggtatggatatttttttgtaatagctcttagtttatccgtagtgggacttggatattatcttataaagaagcattttcattaaatggagaagagtatggattataatgtgataataaacagaaaaaaaattaaaaatgtttatataagagttgatgataatggaaatgtggttgtaaatgcaaataaaagggtaaaagataaatatatttatgatttattaaatgaaaaagatgattggattcaaaaacgtttaaaagctataaataataaaagtgaagtttatgatattaatggaagaaaaatttctgtattcggtagaaagtatataataaaagtaattaaagataagaaaaacaaaatagaattaaaagaaaattattttttcctttatacaaagtatgatgatatggaaagtatggtaaaattaatcaataaatatttaaaagagttgtttttagataatttaaactgctatattattaaagaatgtatgaaagaattccttaaatatcctactccctcaaataaaaaacataaaaaacgtcctaatatttcaccataatgtcccacacactaacataaaaccataaaaacaaaactataattttacagatttgttccccaccctttaataaaacgtataaactggtcggctcggggtagcttttctgacagtaaaacttgggcagagttttacgtagtcatcgaaaagcgttataaggctccacgcccagtggcgcccttttatccaaatatttgggcgagcaaatatttggtcgggttgttaagggcagacagcccttaaagaggggttcttaaggggtagcaccccttaaatttggattgttaagaaagaattccttaaatatcctactccctcaaataaaaaacataaaaaacgtcctcattatcgtaaaatatcccaccccacaatataataataagattgggtagcggtagtggtcgtttcaaaaatctcgggtagagatttttagaaaatccgaccacgttataagccatcacggcgcttgagtgaaagcattttatccagtattttttgctttggaaaaatactggtcgctctttagagcgaaatactaaaaacccacgcccagtggcgcccttttatccaaatatttgggcgagcaaatatttggtcgggttgttaagggcagacagcccttaaagaggggttcttaaggggtagcaccccttaaatacggattgttaagaaagaatcccataaaattcccaccttactacataaaatcataaagaacgacccctatatttcaccataatgtcccacacactaacataaaaccataaaaacaaaactataattttacagctttgttccccaccctttaataaaacgtataaacaggtcggctcggggtagcttttctgacagtaaaactcgggcagagttttacgcagtcatcgaaaagcgttataaggcacttcgcctagaagtgtcctttttacctctttttttggacaagcaaaaaaagagtggggtttttaaggggcaacgccccttgatatcgggttgttaagggcagacagcccttaaagaggggtattaaggggtagcaccccttaaatactggtcgctctttagagcgaaatataaaaatacttttaccaaaattttacataagttatacattataaagctatttaaagaaactatttttctataaaatattaaggataaaggagagaaaaatgaaatacgcaatacttgacatcggcgcaaactcaataagactatgcgtctatgaaggaacaaagaataattttaaaacactttttacaaagaaagtaatggcaggacttgcttattatgtgaaaaatgatgaaatgtcaaatcaaggaataatagaagcaagcaacgtcataaacgaatttaaagaactggtaaataatttcaatatagaaaatttccatattttcgcaaccgcatctttcagaaatataacaaatacagaatttgtggtaatggaaatagaaaaacttacaggtgaaacaatagaagtaataagcggagaagatgaagctttatacggatttacaggtgcaaaacttaaagttaaggctaaaagcggaattgttatagatattggaggaggaagcacggaaattgtagactttgaaaaagataaagtaaattatgcacaaagtcttccaataggctccctaaacctatattcaatgtatgtaagcgaatttcttccaacggacaaagaacaaagaaacataaaaaacaaaatacaaaaaattttaaaagatgttgatattaaacaaactaatactatctgcggtgtaggcggaacaataaaagcagcattaaaattaacaaattcttattttaaattaaataaagataacacaatcataaaaagagaacaaatggaagaaataaaaaaaatacttttaaataaaccgcaaaaagcaaaaaatatcataataaaagcttgtcccgatagagttcatacaataataccgggcattttaatagttgatgaaatactaaaaagaacaaacgcaaaagaaattgtagtaagcaaatacggagtaagagagggttacctatgtcaaaagattatgcagtagaaaaaattataaaagatacaacctgtactcaaaacagagaactaagctggcttagatttaatcaaagagttttggaagaagcaatggacgaaaccgttccccttcttgaaagactaaaatttatttccatttttacaagtaacttagatgaattcttcatggtaagagtaggcagccttgtagatttaatgttacttagcaataaagatacaattgacaataaaaccggctggagtcccaaagaacagcttgaagcaatatttaactcaatacctcctttaatggaaaaaagagacgaagcatttagaacagtatccatggagttaagacaaagaggcatttatgacctttcttttgatgaactttcaaaagaagaagaaaaggatataaacaaatactttgaatactacataaaccctattttgtctcctcaaattgtggataacagacaccctatcccacatcttaaaaacagaagactatacatagcttcaatattaaaaacaaagaaagacaaaaccgtacttggaataatcccaatcccgtcatctcttccaagaatattacctagtaaagaaaacagaaatagatatatacgaatagaaaacgtaataatggaacatattgataaaatatttgatatatatgaagtagtttcaagcaatattatttccgttacaagaaatgccgatataagctatgatgatgataaatttgaagataacgaacatgattatcttgaccatatgaataaacttcttaaaaaaagggattggctgttaccggtaagacttgaaattcaaggtatatataacgataacctaacggaaattttaagaagctttttaaagatagaaaaaaatcaaattttctacagcctttaccctattaaacttgaatatgtatacggtatagaacatatggtttcacctctgttaaaaagcgaacttacttacccaaaattaaacgcaagacagtgggaaagtttaaatcctaaaaaaagcataatagagcaaataagacataaagatgttttactattcttcccatttgaaaaaatagacccatttttagcactccttgaagaagcaggaaaagacccaaacgtgctttcaataaagataaccatatatcgtcttgcaagtgactcaaaagttgctaatctgcttttaaaagccgctgaaaacggaaaagaagtaacagtgttaatggagcttagagcaaggtttgacgaaaagcataatatactttgggcagaaagattaagcgaagcaggatgcagggtaatatatggagaagagggctttaaatgccattcaaaaatatgccttattacaagaaaagataaaaatggaattgaatacattactcagataggaacgggaaactataacgaaaaaacagcagcaatgtatacggacttaagccttataacaatgaataaggatataggaaaagatgcaacaaacttctttcaaaatatgctaatcggaaacttaaagggtaactatgaaacattgcttgttgctccaaattctctaaaacaaaatatacttaaatttatggatgaagagatagaaaaaggaagtaatggaagaataataatgaaagccaattccttaacggatattgatgtaatatataaacttatagaagcatctaaggcaggagttaaaattcaaatgatcataagaggaatatgctgtataagacccggaatatacaataaaaccgacaatatttccatctcaagcattgtaggaagatttttggaacattctagaatttacgttttcggaagcggagaagataaaagaatgtttatatcttctgctgaccttatgacaaggaacttagataaaagagttgaaatagcctgcccgatatttgactataacataagaaatcaaattgatgaaatacttgaaataatactaagggataatgtaaaagcaagagtacttcaaacagacgacacatatagaaagaaagatccattcggaatggaaatgatagactcacaagattggtttttaaataattctcttaaaacatataaaaaagaaaaagataataataataaattaacggactttttcaaaaatatttttaataaataacgattttatcggttaatccgttaaaatatataccccataaatactcttaaaaaaggaaacaaaagtttcctttttttatgtatatttaaaattttttatttttaactacaaagcaaattataactaaaataagaacacaagaacgtacagattttaattaaaaatttttgaataaaatgatttttaaatgtattaaaaactaaaaataataaattaattacttttctataaaaactatttacataaacataatagaaaaccaaatctatattctgaaatgaggtctcatcaacttatataaaacataaaaaaccaaatctatattttacttccatgccccaaacactgacataaaactcatttaacattaatgctatatttatcttctatatccaatatctttacataaaaaatctaaacctttataacctaaaataccccaaactacaataaaaagcaacaaaaaaactttatttatcttacacattcctccccacaaccataaaatcactaaacctctattttacttccatgtcccctctctaatattaaaaagaaaaactaaacctctattttacttccatgtcatacccccatcacataatatgaaacattaaaaaactaaacttaaatttcacttatatgtcccaccccactacataaaaccgaataattaggtcggttcggggtagcttttctgacagtaaaactcgggtagagttttacgcagtcatcgaaaagcgttataaggctcttcgccgagaagtgtcctttttacctctttttttggacaagcaaaaaaagagtggagtttttaaggggcaaagcccctttatttattttttacgacaactatccttatacatacacccatcacacccaccgctgcatttacctttgttttttatgcttttgtaaagtgcaaaaataaaaagtattataattattaatgctgcaacataagaattaaaattcataatcttctcctattttataaatatattgtaccccttaaaaaaataaagtaaatctatttttataaaatataatataaatattttattaattttatactattttgtaattatcaatatctataacatcctaacaatcatataccaatatttaatattatcttatatgtattaatgttttcattacatattattcaattaactttataaaaaaaagagcagattttactactctttagaatctacccacattaaaacctttttacaatttggacagtgccaagctttttgctcttccatttttaaaggaattgtaatggtttttctaaacatggctttaaatccttttttctccgcttccttttttgaaataaactcgttccatactccaagggctaaactataagcaattacacttccttcttccatttctaatccacaatcaagacatttcatttattaaactcaccttttacaattttacaaattataccataataaaaattgatttccccttttataaaaaagtcttaatatacttttaagaattaatatacttaatatatttattagttttttatacaaatttttcattttaaatactattttgaaataactctctatttaaaacaaaaacttacaactttattacaaatattacaagttaattaaataaacgataattcgttgacaattaatcaaaaatattatatattcaagttgtaattagaatcattctaatttaaaagcaaaatatataaatacattcgttaaaaacacttttgatgtatgtttatataaataaattaatgggtaaaaatggtaaacataaaatgtaatgaaatatatattaactttcaaggtaaaaacaaaaatataacttatataaaatatatcgaaagtgtaatacataaaaactcataattaaaccatgagaaaaaatttaaacatataaaggaggtaaaaaaatgagaagtattacaacattagacttacaatacgcacacagattttacggttttaaaggagaagcacaatatcttcatggacatacaggagttctaacaatagaagttgaagattcaatcgaagaaggagtaaacatggttttcccttgtaacgaaattcaaaaaacagcttgggaagttttaaaaaactttgaccatgcactaattctaagagaagacgacccgcttttacctgcagttttggacgtttatgaaaaacaaggtataaaagacggttcaccacaaaatcaaatgaaaggacctaaatttgaaactgagcttgcaaaagcctatccagaatgtcgcctagttgtaactaaagaaacattgacagttgaaggcatgataaaaatcgtatacgatttattaaaagataaacttaacattgcaaaaatcacatttacaagcggtgtaaatgcagcaagcgaagaatttgaaactaaaaataatatcgaacattgcccactttgcggaatagcactaaacgaaaaaggcatatgtccaaaatgtggatataaaaaagcataataaacttaaaaatacgatataaaactctaatgtatgataaaacttatattaataaataataaaaacatatctaacaacactctatgtattaatacaaatatataactaaaaaacactactccgattaatataaaaagcaacttgtaattgttatataaatccataataaaatttaataaattgataaaagttatatatttgtagacacaaaaagaccggtataaaagccggtcttttgtattttaaacaataattgattacataaaaattataagaacaaaatctcttttatcttctaccctacaacctaatataaacatcattaaaatatcaaactaaattttataatggatattattaatttcctaattcttcccttagcttattgatttcatcataattcaaatcatcagtacaaacataatctacattcattttaaataacttctcagcttcttccaaatcatttatagggaaagtattaaaataataaccgtgtttatgtacttcatttgcaaaatcttcgtttgcatatcccttatgacatccaaccgttacaaatccgttatgtgtatccatgtactctaatatttcatcaagttcattattttcatatcttttcctttgaatataaaactgtttaataggaaaatcatatattttttcaatagtttcaaacatatcgattgaacctgcttgaacaacaactcttttaataagtctcttcttcaataatttctgtgttattattttatacattttttctgttgtttctatatccaaatcttttgaaatatctataagaacatatatatccttatatttttttaaaagtgacataacatcatcaaaatccattgtagtatacttatcacatattttaatctttttaaattttttataagataataattgaccttttttaagataccctagtcccaaagtttcatatatttttttgtgataaggatgaagtgcaacaattttattatcactagtaaaagaaaaatctacctcaataagttttattcccttatttattgtattttcaaaagcttcttttgaattcgtataatgtattccgtcaatttctccacaagaatgagccataatacctctttttaagaaatttagagcatttttctttttataattataaaaaaataacatacaaacgacaatgacaataatgcttacaaataaaatttttaaaatattttccattttctttctccctttacatattacaaaatataaaatataatcaatattttgtaaatttcattctccataatcccctatagaaatattacaaaattcatttaaatatataattataatttaaatatattttaacatattttagataatattaatatttatttataatatatattttttgttatataaaaataatatattatcttctaatatatctataagattagaataacattttaactttcaacacaaaaagaaactatcattaaaattttatatataaatttataacataaaaagctaaattaattggataaaggcagtgatcgtttcaaaaatcttggttagaaatatttagaaaatccgaccacgttataaagtgcttcgccttgaagtcttttttaccttttagggagaagagataaatattttactgaaagcatcataaaccaattccttaaatgcctgcacccatattttacttcaatgatcaaatcccccacaaagaaataaaacaacaaacttatatttcattgatatcttctattctctagcacataaagaaataatagacctatatttcacttctatgccccactaccgtacataaaaagctaaattagttgggacagcggtagcactcgttcatagaaaaatcgggtagatttttcatgaaatccgagtgctaccaatatttacatgtggtttagttctttcgtatttttctcttgccatttttattctccttaatctatcattaattgtatattattcgtttttaagtttatctaacatactttgaggtgctggctcataatgagagaatgtcaaagtatgagttcctctaccttgagttttacttctaaggtctgttgtgtattggaacatttctgataatggaacaaatcctctaagagtttgaacaccattatgaagttccataccttcaatcttacctcttcttgctgttaagtcacccataacatctccaaggtattcttcaggaacaacaacttcaattttaaagataggttcaactaaaacagggcctgctttagccatagcttctttaaatgccatagaaccagccaatttgaaggccatttcagaagagtcgacatcatggtaagaaccgtctactaatcttactttaacatcaataacttcatatcctgcaaggataccattttccatagctccttgaatacctttgctaacaggttcgatatattctttaggaattgcaccaccaacgatttcgctagtgaattcataacctttaccttcttcatttggttcgatttcaataacaacatgaccgtattgacctctaccacctgattgtttagcatatttatagtcagctcttgctggtttagtaattgcttctttgaatgcaacttgtggtttaccaacattagcttcaactttaaattctctaagaagtctatcaacgataatttcaagatgaagttcacccataccttcaataattgtttgaccagtttcatcatctgtcttaaatctgaatgttgggtcttcttctgctaattttactaaagcagcgatcattttttcttgacctgcttttgtttttggttcaatagctacagaaataactggatctgggaattcgattgattcaagtaatacaggagcattttcagcacataaagtatcacctgttgttgtatcttttaaaccaactaaagcaacgatatcaccagttctgatttcttcaatttgctttctgtcgttcgcatgcattcttaaaatacgaccaactctttcttttttaccttttgttgagttatatacatatgaaccactttgaagtgttccagagtaaactcttgtaaatgctaatttaccaacaaatgggtcagccataattttaaatgctaatgctgagaatggatcgtcatctttaggatgtctttccatttcatcacctgtttttggatcatgtccaatcatagctggcacatcaagtggagaaggcattaagttaacgatagcatcaattaacatttgaacacctttgtttttgaatgctgtaccgcataatacaggtataaaatcaagatttagaacaccttgtcttaaagaagcaataatttctttttctgttatttcttctccttcaaggtatttttccataatttcttcgctgtttacagagatttcttctaataatttttctctgtattcttcagctaaatccatcatatcttcaggaatatctgtttcttcaatatcattaccttggtcatcatgataaataaatgctttcattttaaccaagtcaacaatacctacgaaatcttcttctttaccaataggtaattgaattggaacaggatttgctccaagtctttcgctgatcatttttactacattgtagaaatcagcacccatgatatccattttatttacaaatgcgattcttggtacgttatatttgtcagcttgtctccatactgtttcactttgaggttcaaccccacctttagcacagaaaactgcaacagagccgtcaagtactcttagtgaacgttgaacttctactgtaaagtcaacgtgtcccggtgtgtcgatgatgttaatttcatgacctttccaatgacatgttgtagctgcagaagtaattgtaatacctctttcttgttcttgttccatccagtccatttgagctccaccttcatgagtttccccaattttgtggattttacctgtatagtacaagattctttcagtagttgtagttttaccagcatcgatatgagccataattccgatatttctaactttatctaaactaaactctcttgccatcttttattcaccttaccatttaaaatgagcgaatgctttattagcttctgccattttatgagtatcgtctttctttttaactgaagcccctgtgttattgatagcatcaataatttcagcagctaatctttctttcattgttttttcgcctctggctcttgtgtaagttacaagccatcttagacctaatgtttgtcttctatcaggtctgatatccattggaacttggtatgttgcaccaccaactcttctggctttaacttcaagtgaaggcatgatattatttaaagcttcttcaaaagcttctaatggttcttttcctgttttttctgctacgatgtcaaaagcaccgtatacaattttttgagctacacctttttttccatcaagcataacgttgtttaataacttagttactaaaactgaattatacattggatcaggtagcacttctctttttggtactggaccttttcttggcactgtacttccctcctaataatttaaattttttcattggtactcgataagtaaaaatttatcgttgtgctctatatattagatatataggtataaggcttgccttatagttacacacattataaattatttcttagcaccgtatttacttctagattgttttctgtcagcaactccttgagtatcaagtgctcctctaataatcttataacgtacacctggtaagtctcttactctaccacctttaaccataacaacgctatgttcttgtaagttatgaccgatacctggaatgtaagcagttacttccataccgttaacaagtctaactctggcaatttttctcatagctgagtttggttttttaggtgtagcagttcttacaactgtgcacactcctcttttttgaggattagatttaagagcaggagatttagttttgtaaactaagtcttttctaccttttctaactaattgattaactgttggcattaaaccttattcctccttcctcaaatttttaatatacaagcaacagcagcatctatgcttatgttgcatgctttacctaattctttttttgtggctacatattctatagtcacattgtttttttgacaaatattaacaattttgtcttttattgccgtatctgtgtccttagccaaaaacacttttaaagcttctttttgttcaaccgcttttaaagtctgttttgtgccaaccacatattgtgatttaggtatttcattaagcattttttcaactccttttcacagtcagcctaaaaagtttatcaaaaaaaacttgaaatgtcaataaaaatcggcatttcaacgattttttttatattatttaaaactaaaaaaacacttaacaaaatttattttatacctttattaaaaaataatccagtactttcatattattttacatatttttttacacttattaatgttaatattacactaacagcaaaacaaattaaaaatatgtaattcatttcatctacaaatgtattgttcataaaagatataaaactaaacaaaccaaaaattaaattacaaaaacaaaacaataaaacaaaaaatccatttaataacttcatatttgtcacctcatacaaagtttataaaatgggtttcaaataatttgtagttttataaaaaaataagactgatttttatcagtcttactctatatttattgtgatactgtaaacacacccgctgtcaaccaaatcaacatcatctttatttatatcacttataattgcatctatatagtattctccaggtttcaaatttccggtttctactatgatttcttcgcttatctctccggttacattatttattgttttattgtaagcgtatgtttcattgtttacatcatatatacccaaaaatatgtttgtattcccctcttcaaatatatcttttgcttttaattgaagttttattgttgctccacttgaaaaagtttgtccatcttcaatattacttatataaatgttcttatctttaaacttttcatcttcatctttttttccgaaaatattattaaaaaactctactataccattttgtttttcttcagttgaatatgaagcactattacttacattagaaggttcactagataaatagttagaaataaaaaaagctatacagccgaaaagcaatccaagcaacattataaaaacaataataacaaaaaataaatttcttaaagaactatttcttctgcgtctttttcttctcattacatttactccaatatattttggtttttttaaaaatatatcataaaaaaattataactacaatgatatatataaaaaaagagcattaaagctcttttatatctcatctataattttaccatctgtggaaatagtaacaacttgccatggaataaatttcccgctttcaaaaattgctttttttactgcattttcaattcctccacagcaaggaacttccattcttacaactttaacactttttatattattttcttttataatagctgtaagtttctcactataatcaacactatccaatttaggacaacctataagtgttatatggtcttttataaaatcattatgaaagttaccatatgcataagcactacaatctgctgcaataagaagttttgcattttcaaaataaggagcattaacaggagctaatttaatttgaacaggccactgtgataatttactattaacatttacatattcatttttatttattgattcatctaattcattttctttcctatttattgcttttgaagaacttcccggacatccacaaggaagattgttttttttcttttgattttccataacagctttttcatcataagccaatgcttctctttcttcaaaagatatagcacctgtcggacaaactggcagacaatcgccaagcccatcacaataatcatctctgagtaattttgcttttccgttaaccattcctatagctccttcatgacaagcctttgcacatagtccacaaccattacatttttcttcatctattttaataatttttctaatcattatttccctccaaaattataaattgattatttaatggcattataatataatgtatataaaatatacgttgcaaatgcaacaagaaaggatttttatgaaaaatttatatgaaaaattaaaaaaaatacctttattcaacaatgtacaagaaaaagaaataaatgaaataatagaccaatcatatataaaatcatatcaaaaagatgaatatattttaaaagcaggtgacttcacatctaatacaggaattattttaaaaggagaaatcagtgttattagtgaagacttttggggaaataaaaatataatttcaactttatctaaggggaatatttttgcagaaatattttctttaaaaaataatatacctttaaatgtaagtgttatatcaaatgaagattcaacaatattatttattaatgtaaatgaaataataaacaaaacaagaaactttatatttataaaaaaccttatgaatataataagcacaaaaacgttaatgctaaatagaaaaaacgaacttctgtcaaaaagaaccataagagaaaaagtcatgacatttttatctcaacaagctataagtgcaaataacaattcttttaaaatacctttttcaagagaagaaatggcgaacttcttggcagttgacagaagtgcgttatcaagagaattatcaaaaatgaaaaaagaaggaattataacatacaataaaaataattttacattaattacaaaataattttataaatatatgttaatcaaattgtatttgttaataatttcttccattctttctatatttatatcagaatgttcaagctctcttgaatatctccatgcaagttctactttatcattttcacaaaacctatcttttaatattgatttttgtagcttacaaataatatcccaaatatatgtacttaaaacagaaataccaattttagaaatgatatcatagtcataaactccaccagaaaaatatacatatataaaatatactaatatttgttcaagctgtatttgtgaattgacttcaaaacttaaatcaatatttttttcacaaataagtttattccatctttctttatcctcattccatttctcatctaaaagttcaaactcatttaataatcttagtattttttttgcattgtctttatttatccatttttcatatattgtttctatttcttcgtttttaaatttttcttcgtattcaactaagatattttctatattaaaaatattattttcatctatgcattcctgtattttttcacaaagaataaataccttatttattctaataaatatatcttcatttctgttttgaattatttctaatattactttcctgctttgctctaaggctgaatataaaaagaaatcaaaatcatcatcttcaacatcttctttatcatcttctactgttataaatgaaaccttatttttattacttaaaaccattttagcaaccataggacaagacaatgcaagagaaatctccctctcattttcaaactcttctgtatgatatggataatttttacatgtatcacacatcatttctctccccgcttctatatgtatatcgcaaagattatcttcatttaaaaatgcacatcttttattatattgtttataaactcctttatcaaattcaacagagttcttaagtctattcccaaaatagctttcacaactcatatatttctcaattgtattttcatcaattacaatttgccacccttcacaacagcttttagggcatttatccataagacaataaaactttttataataatcaggatatgtatataacataaccatcctccttgtttaatatataatatattttaacattttatttacaaataaaaaagccgatatatatcggcttttaatcttctcttttatctccaacaaagaacaaagcaaccgtaccgggaccagtatgagaacctattgttgttccgacactatttataactactttcccatctaaatttttaaacttttgttcaattttatctgctacggcttttgcatcttcaaaacatgcagaatttgatatgtaacattttccgctataatcaagaccatcttttgcatgctgttccattctttttacgatttcttcaattacttttttctttcctctgtatttatttcttggaataagtttcccatcataactcatatttaataatggacaaattttaagagctgtaccaaatatagcagatgttcttgaaattcttccacctctaaagtagcttgttaaatcagttgagaagaaccagtggtgtatatttagtctgttatccaatacccattttgcaacttcatcaatgcttttaccttcttttttcttttcatttgctaatgtaacaagtaaaccatatccgcttgaagcaccaagagaatctataacatagatttttctatttggatatttttcttcaagcgtctttttggcaatatttgcagaattaattgttccggaaataccgcttgataaacttatatgcaaaatatccatatctttttttaatatactttcaaaaagctctatatattcttcagggcttatttgagaagtcgtaggcatggcaccctgctcaatttttttataaaattcatcaaatggtatcgtctttcctaaatcatccttatattctttaccatctaaaatataatggaaataggctaaagggatatcgttttgtttaaagaactcataactcatgtctgcagtagaacaacatgttattttataatcactcattttaatccctcccttatatatatttattatatcacaaaataagtttttatataatgtaaatgacatattttcataatatcaaaatatcatcatatatattaatatgaaaaaaatatttaataacacaaaagaaaaaataacaaaatctcttcaactcccacaagagattttacttgaaaaactaaatatagaaattctcggaaacgaaaaaatgaacataattaaccataaaggaattatttattacagcagtgaacacataagaataaactcttcgtcaggtttattgtcaataaaaggaagagatcttcttttatcaacattaatcagtgaagaattaataattgaaggacaaatagattcaatcgaatatatcatataggagaacaaaatgtttattttaagattttatccttttgcaacctttgccttttttgttatatcggatacagatgtattttctattccttttgtggtaaataaaataaaagcacaatcaagaagattatccaatttttttcttttcttatcttcaataatacccataataatctctcccttaataaaaaagtagcacattaaaaatattttgtcaattgattaaattataaaaaatgactaatagtcaattttttatataaataatattgactattggtcatttttgtattataatcccatataataaaaatgactaatagtcatttttattataaaaggaggagagctaatgaataaaatatcacaaaaaatagtaaaacatagaattcttattttattaattgctgttttactgttaataccttctgttatagggtttataaacacaaaaataaattatgatatcctttcttatcttccaaaagatttggagacgatgaaaggtcaagatgtacttatggatgaattcggtaaaggtggattttccatgtatatagtaaaaggaatggataataaacaagttgaaaatttaaaagaaaaaatagaaaaagtaaaccatgttgactcagtaatatggtatgacgatatcttggatttatccgtaccaaaagaaatactgccggataatatttatagcacttttaataataaagatgaaactttaatggctatattctatgatacttcaatgggttcagacgaaactatgcaggcggttgaagatataagagatatttcaaacgaagaatgttttgtaagcggaatgtcttctgtagtaacggatataaaaaatcttatcaaccatgaaacagttgtatatgtaatcattgccgctatacttactggattaattttaggtttttcaatggattcttttatgatacctgtatttttcttacttagtataggtatttcaataatatacaaccttggaagtaacttcttctttgatgatatatcttttataaccaaagctcttgccgctgttttacagttagctgttacgatggactattctatatttttatatcacagatacaaagaagaacttgctaattaccaagataaaaacgaagctatggctcatgcaataacaaatacttttacatctatagtaggaagttcaataactacaatagcaggatttttatcactctgttttatgacatttactttaggacttaatcttggaatagtaatggcaaaaggggttgtaataggaataatatcttgtgtaactattcttccatcactaatacttacttttgaaaaatctattaataaatttaaacatagaaactttatgccaagttttgataagcttagtaattttgtcataaaaaattataaagtatttgcaattctattcttagtaatattgataccttcaatatacggatacaacaatacaaaagtttactataacttatacgatacattacctcaaacatgtgaaagtataaaagcaaataacgaaatagaaaaaacatttaatataggttcaactcatatggttcttcttgataaagatatttcaagaaaagaaagttatgagctaacaaaaaaaatagaaaatattgatggagtaaaagatgttttatcaatggatacaataattgatccatcaatgcctgatgaaataataccaaatgaattaaaagatcaaattgaaagtaataactataaactaatgattattaattctaactataaaacagcatcagatgaagtaaataatcaaataacaaaaatacaaaatttaacaaaatcatatgataaaaattcaatgtttataggtgaagctccttgtacaaaagaccttattgatgttacagaccatgattttaaagttgtaaattatatatcaataaccacagtattcttaataatacttacagtattcaaatcaatttcaataccggtaattttggtaacaataatcgaatttgcaatatttataaatatgggactatctttctacaccaatactacaattccttttgttgcatcaatagtaataggaaccatacaacttggagcaactgttgattatgcaatattaatgactacaagatataaagaagaaagagaaaaaggaatgacaaaaaaagatgcggtattattagctttaaaaacttcaacaagctcaattattgtaagtgctttaggatttttcttatcaactctgggagtttctttatattcaaaaatagatatgataagtgcaatttgtactcttttatcaagaggcgcaataataagtatgtttgtagtaatactaatgcttcctagtgcacttatgatattcgataaattaataataaaaacaacttataaatttaaagtaaaagaaggagaataaaaaatgaaaaataaaaagaaagtattatctttaatattatcatctttatttgctttatcaatttgtactccaagcgtatttgcaaaagattcaaacgtaagtaaagaagaaagcgtttatgttatatcagatgccaacggaaacgttaataaagaaatcgtaagcgtaacattaaaaggcggtaaaaaaggagaaaaaatagaagataaaacaaacttaaatgatattgaaaatttaaaaggaaatgaaacttttgataaaaaattttcagaagtagtatggaattcacaaggaaaagatataacatatcaaggaacttcaaataaaaaacttccagtaaatattaaaatgacttattatttaaacggtgaaaaaatatctgcaaaagatattgcacataaaagcggtaaaataaaaataagaatagactatgataacgtaacatttgagaataatgcttttatggcagtatcaggaatgattttagattcaaataaaataagtaatataaaagttacaaacggaaaaagtgtagatgaaggagaaaatacgattgtaatgtgttatgcttttccgggacttgatgaatctatttcagtaagaggttttgatattccttcatatgcagaaataacttttgatgcaaaagattttacaatggacggaacaatgagttatgtaacaaatgaagtatataaagacattaacttagacgatgttgacagtattatggatttaacaaattcattaaataagttaagcagttcttcaaaagaacttgttaacggttcaaaatcattaaacgaaggtattaatcttttaatagataaatcaggaactcttacaacagggatagataaactaaacagcggtgcaaaacaacttgcaaaaggaagcgaacaactaaaagtcagtgctaatgatttaaaagacggagcaagccttttatctgataatataggaaaactatcatcaggtatagaagctacaaaaaacggaagcactaaacttaaagatggaataaataaagcaggtaacagccttagtgaaacaataagctacaacgagcaagtattaagcggattaaatacaacaattgaacaacttgaaaaatctcagcctgacagtcctttacttgaaaatttaaaaacaatgcaatctactttatcacaaactataaatgcacaaaaacaaattcagtacagcttaactagtaatgaagaaggtactattttaaatggtgcttcaagtgttgaaagcggtcttgatacattatatttatcaagtaatagattaaaaactgagggaagcgaccagatagttttaggagtagatcaatttataaatcaaggtattaatcctttaattcaaggaagcaaagatttagacagcggacttacaacattaaaacaaggaagcgataaactaattgaaggaatatcatcccttgaaaaaggttctaaagaattagaagaaggaatggatacttttgataaagaaggaatagaaaaattagtaagtacacttggaagtcttgatagtttaaaaggaagaattcatagtgtagtagataatgcaaacagttatgataacttttcaggacttagtgacggtatgaatggaagcgttaaatttatatataaaacagaagctataaaataacaaataaaaaaagaataacattagttattctttttttatttatattcacttaaaaattgttccaaatttttaacatcttcatcatttggatgatttagagctatatcaaaattttttatcatatcttttattccttcattatcaggattttctttaagtatattctcatatctttttcttattcccattcccattttaccctgacatataaagtaatcaatatattcacagctttcatttattgatttttttacattatctattatcttatcgtaatattctttattactcataaatcccgcagtaccaaataaaactatctttttattttttatcttacttaaaagttcttttatttcatcggttgcatttcctttatctgtccaaaatcccacaaaaacaatatcttcattattgtcttcataaacaccattatatttttcaaatttaacaattttatcttttaatatttcatttattttatttgcaataaattctgtattaccagttaaagaattataatatatactgtatttcataactttctccttatgtatttctatttattatatatatttttatattttttcaaatacttttaacaaaaaaagaaccaaaaaggttctttttaagaaagtcttacaggcattattagataagtatatttctttgaatttaccggttttatcaaacaaggactgtttgaagaattaaattcaagtataactttttcatcttcaataactttaagagcatctattatatatctgctgttgaaagatatatcaagatcttctccgcttaaattaatagaaatattttcttctacattaccaaaagcagatttacttgtaagaagtaaattattttcgctaaaatgcattgttataagatgagctcttccttcatctgaaatgattgaagctctttcacaagctgacaataattccattctgttcattttaacaattgttttgctttcttttggaagaagatttacataatcaataaattgaccttgtaataaacttgaaacaatttgtgttcttccaacacttgctatgaattttttatcattaatatttaagaatacatcatcttcataatttgtaagtattttattaagctcgtttaaagtacttgcaggaacgacacattttatattattcatatatctttcctttgactgttcgcttcttatagccattctgaagccgtctattgcaacgaatttaatatcttcatcattattttctataagtatacctgttaaaataggtgaaacagaatcagaacttgcacaagcaaatgatgtttctttaatcatgtttcttattgtagcgttatccatttttataaagtcatttatattataaacttctttatttgggaaagttctgtaatccatggcagaaatattaaatttagaatttaaacaagtaagtttaatattgttattttcatctgcatctatttcaacttctccattatcaaagcttcttactatatcacttagtattcttgaattaataagtaatttaccttctcttattacttttgcatctattattgtagatatttgtatttctttatttgtagcatatagggaaagtacatcatcataactttcaagaagtattccttctaaagagcctacatttctaagtgttgttgctttacttactgttacaagtgcttttagaaattcatttctgtctacttttatattcatgttttcatcctttcatgtttagtgggacctatctatataatatttattttttattaaaaagtaatagtattagtagtgttgataatgttgataacttcatttatcctttttaataagcattttttgactgttttttaatgttaataaatcaaaatatttataggataagtctattaataagttgttatttactgttttttatgcttgatgttatcttatctatttcttcttgaagtccgccgtttgtttttaaatcttcttttattttgtcatatccgtgtattactgttgaatgatctcttcctccgtaatattctcctattgtaggtagagagttatcagtaagttctcttgataagtacatacatatttgtcttggatatgctatattttttgttcttctttttgataaaatatcatcttttgttatattgtaatattcacaaacaacttttgttattaaatcaagagatatttttttatcacttatatcaattatatcttttaatcctttttttacaaggtctaatgttaaaggtttattataaaattcgcttaatgccattacctttaaaagtacgccttcaagttctcttatgttggattcaatattttctgctatataattaagtatttcgttacttacctgatagttttcttctttagctttctttcttaaaattgcaagtcttgtttcaaaatcaggcattgatatgtcgcatataagtccaagagagaatcttgaacgaagtctgtcttcaagattatgtatttctttaggtggtttatcagacgtaagcactatttgtttatttgaaccttgaagtgcgttaaatgtatggaaaaattcattttgtgtttcgttttttccggcaataaattgtatatcgtctattaaaagtacatctgcgtttctatatttatttctaaattgtacgtttgttttattttgtattgcatctaaaaactcatttaagaattgttcgcttgatagtagcactactttttttgtagggtcttttcttaaaatatgttgtgctattgcgtgcattaagtgagttttaccaagtccaactcctccatatataaaaagcggattgtatttcttagccggagcatctgcaaccgcaactgatgctgcgtgagcaaatctgttatttgcacctacaacaaaggaatcaaatgtatatttaggattaagctgaatatatgaagtattatatatattatattcaacgttttttttattttcttttgttgctgctatttcttttagtgcttcttcttttgtatataccatatcgtttgaagaagcgaccacaaacttaacttttatgtatctttgagtatagtattttaatgcgttttcaaccagtaccgcatattgcccctcaagtaaaattttatttccctcatccggtacttgaagatagaaagtatcatcttcaaaggctaggggtgtaatggatgattcaaagtattctttgaatacaaaatccgaaagttcatcttccagatattctagtgcgttattccatagttcttgttcaaaagacattacaacctccaaaataatattgatatataaatcaatctaattttttttattctttttgacaaattattcacatatgagttatcaacatataaacgaacgaaaaaagcgtatttttaggaaaaatgcagaaaaaaaataaggcttatccataaaacaccaacaaattgttaataactttacaaaatatatgtagataagtggtctttttacctattatagcaaaaaaaaacaatttatcaacaattaaattttgagttataaacaggtgaaaaatacataaaaaacacaatatatattaaaaatttttatatatttttatgtattttgtgtttttttataaaaaaggataaaaaaatttaaaaaaaattttataaagtcaataattttatttacatattgtttacaaaatatttatccattaaagatattactattttatatcttccattatatcatacattttatcttctttttcactaaatgcctttatacagcaagtgaaaaatgatctaaaatcttcaggattttttacgttttgatatggtgaaacagtaaataaaatatcacctaaattttcatttatttcattatttaaatgaatcatatcaaagtttttagtatcaaaattttcaaaacattttgtaagaagagacaaagcatgaatttcttcatttgaatataaagatacttcataatttatatctaaataagttatatcttttgtattgtctactcttacgtaaatatcattattaccttcatgaataatttcaacatcatttacaacaataggattttcatctatatcttttattgaaattctcggaaccaaagcttttacttcatcactatcaggtgtttgttgagcttttaataaagattttgtactttctaccaaactttccaactctttatcatttaacgcttttttaaattctccaagtttttcttttaaaattttatcatttatttctgataaattttcttttggtgagagtatcacaaaattatatttatcattttctacaataaattcttttataacattttcaaacaaaccattttcggcttctttttttatttgctctaatgcatcttcatactctaaaagtaaagtcggatttccgtcatataaccaactttccattattgtaataccgtaaattagaccttttggatatgttcctgtatcagcttcttttaattcaaattcaaaattattaatagcagatttaataatatctttatctataccatcattaatgatttttttaaatgtagatataacagtttctttaaataattctattttgtccttctttgcgtttttagcaactatactaaatacaggttgaagtattccattgttataatcaagaacaacttcatcagcgattttcgcatcaagaagggctttctttaaatatgaagaatcagaatcaaaaagaatcttacataatattccaaaagtaagaccaagtttaacatctaaaacattacctatgctgtaatttaaagcaagtaaatatttattgtctatattttcatttgaatttacagaatagtatttttcaacccttttttcaatattggtaaaatcaacttgttcattaatttttgaatctatttctattttttcataattacaaagataagatttatctaaatactcaaggtgacgtaaaatatcagtatcaccatatatataaatgtaagaattaatcggatgataatatcttttgtgaaaattcaaaaattcttcataagttaaatcaggaatatattcaggatccccacctgattcataaaaataaggagtgtctttatataaattggactctatgcttcttgcaagaatatcttcaggatcagaaaaggcacctttcatttcattataaacaacaccattgtattttatttcatcatttttattttctatatgataatgccatccttcctgttttaatatttcttctttatcatatattaaaggattaaaaacagcatctaaatatacatccattaaatttctaaaatcagcttcatttgtacttgcaattggatacatcgttttatctgaaaaagtcattgcgtttaaaaaagtattaagggatgattttataagctcaataaatggctcttttaaaggatatttttttgaaccacaaagaacgctgtgctctaaaatatgagcacttcctgtattgtcgacaggaggcgttctaaaagatatgctaaatactttattattatcatcattttcaatatataaaagctttgcaccggattttatatgttcaaattcatatgaaacagaatttatttcatgaacattttttatatttttcaacataaagtttgaatatactttattttgctctaatttcatttctacctccaagtgtattctttttttgcttatcataaaaatatattatatataattttgctctttttataaatactttatttatataaatttaaatattttactttttttataaataaaattaattacaaaaaagtgataataatgttaaaattttattaaatatttccaaaatggaacatatagcattgataaaaatatttctatgctatataatgttaaagaatatgctatgtcatataaatttggaggtaaaaaatgagcacaaacgacaacatgactcctaataatatgcaaaaaaaagtaaaagtgcgtaagaaaagagtcagagttaaaaaacctaaagacaacatgaaaaaaagcaacattaccaagaaaaacatcttaggtaaaaataaagctggcaaaggaaaattcaaaaaaggaccaggcaaaaaaataactttcaaaagagttcttgcagctattgttactttaggtattgtatgttttataggtgggttcgctctaatgcttgtatggatggctcaagcacctgcacttgatttagataaatttaattatgcgagtgcaactcatttattagataaagatggaaaatactatcaggaacttcaaggttctgaaaatagagaacctgtaagtatagaagaaataccggaaattgttcaattagcttttgtatcaatagaagacaaacgtttctatgaacacggaggcgttgaccttataggtactagtaaagctattcttggagttttaacatcaggaagcactgatggtccgggtggaagtacaataacacaacagctaattaaattaacacacttaacaagtgaaacatcaataaaacgtaaagttcaagagtggaaacttgcaatcgaagttgaaaagaaactatcaaaagaagaaattcttgaagcctatttaaataaagtaaacatgtcccaagcatggggtattcaatcaggagcacaatatttcttcaaaaaagatgttgatgaactttcaattgctcaagcggctgttttagcatcaataatcaatgctcctacatattacaaccctcttgtatatgaagatgaaaacggagatggtgaatatacccttgtaaaagaaaaaaattctgaaggaaaaacagttcttgcatacgatgaaaacaaccaagaaagagcgttagaagtagtccaaaaaatgtatgatttaaatcatataagtaaagaagaatacgatatagcagtggacgaattaaagaataacaaaattggattggttgaaaacaaaagtaacacagtatactcttatttcacagatgctgtatatgaacaagttgtaaatgatattgcagaaaaatataattattcaaaagaagatgcatcaacatttattcttaataatggattaacaataaaaacaacagttgaccctgatgttcaagatgcacttgaaaaaactgcaaaagatgattctatcttcccttctcaatcatattctgcaagtcaagctagtgctgcaatgacaaaacaaaaaggcgaagaagtagaatataatccggaagttggtatgactgtaattgaaaataaaacaggaaatgtagtaggaatagttggaggtagagaaaaatctgcaagcttatctatgaacagggcaactcaaaaattccaacctggttcatctacaaaaccacttacaacctatgctccgggaattgactcgggaaaaattaccgcaggcacaacatttaatgatacaacaatttcttacggaggatggtcacctaaaaactccggtggaggaaatcaaggactaatgacagttagaaatgccctaacaaattctgtaaatacagtagcagttcaagcaatgttacaaaccggaacagaaacaattcttccttatgcagaaaaacttggacttgatattgtaaaagatgaaaatgatgtaaatgacttaaaccctgccgcattggctctcggtggttatactcatggtcaatcaacactagcgatggcaagtgcctatacaacctttgcaaatggtggagttagacaaactcctattatatatacagaaataaccgataaaaacggtgaaataatattaagtaataaatctgaaaaagtaaaagtatttgaagaaggaacagcttttattatcacagatattcttaaaaatgttgtaaaaggcggtacaacatatatttcaatcgatggtacagaagtagccggtaaaacaggtacaacagatgaaaacagacatgcatggttctgtggttatactcctgaatattccggagctgtttggtatggatacgaccagaacgtcgtcacggtagatggaacaacctataacttgaatatcggtacttatgggggttctacaaacggacctgcagctttctggaaagaagcctttagtgaaatatatgataaaaaagacatagaaaacagtaagtttgcatctcaaccagatgatgtttaccaagcaaaagtagacggagtatcaggtaaaaaccctacttccctttcttcaaaagacccaagaggctctaaagtatacacagagtacttcttaacaggtaaaggacctagcggaagtgataacattcatgtttctgcaaaaatatgtgaagcttcaaagaaaaaagcaacagagtattgtcctaaagatcaagtaaaaacatctgtattactggatttaagcaagataacttatccacctggagtaacaggtaaaaatgaaattggatcacaagcaaaatacagtctaaaaggttcttgtgatgtacatggaaaatcaactgtacattctataaaattaacaataagcccaggctctattgaggcaggacaaacagctacagcaactgtaaccggaactttggccgatggctcaactaaaaatattagtgcaagtctatcttcaagtaacagctctgtagcaagagtatcaggaagtacaataacaggtgtaagcagcggaagtgcaacaattaccgctaaatacacacaagaaggaacaacattaactgcaagtgctacaattagtgttagtggttcatcaagtcctacagtatcgtcattctcactaagtccttcatcaattacaataagtaaaggcgaagattattattcacctactgctataataagcttgtctgatggttctacagattatggaaccgtaacaatagaagatgatgatgactttgacagtgaatctccgggaacatattcaatgacctgctctgtaagctataacggaacaaaacttggagaaaaaacatttactgtacatgttcaagataatgaaggaagaatcagaaataataaagtaacccaagcaagtttaaaaagttctaatacgttcagtataaaaaatatgttttatagcttattttaaaaaaaagcaccttataaaaggtgcttttttattttattaaaaagtatacaaattaatattttggaaaaaataatctatataaataattttcccaaaggtatacaatgaataaattatataaaaatttaaaaattaacaaggcaataataaaaaatcaatttaataatgacgacacaataagatacagagaatttaaaaacaaaggaataagttatcttcttttatttattgacggaatgtcaaacagtgaaagaatcgacgaagatataataaaaccaattttagaaaataaaaaaattgtttttaaatttaacattttagacaaattaaaaacaaatatactattttcaaatgatgtaaaagaaaaaaatacatttgaagatatcttttccgatttgctttacggaaatacaattttaataatagaagggcaaaataaagctttaagtattgatacaaaaggttttactttaagagcaataatggaaccccctagtgagaaaattgcaaaaggaccaagagaaggctttggagaaaatatccttacaaacttatcattgcttagaagaaaaatacaaagcccaaatttaaaatttgaattttcaactatcggtaatgttacaaaaacaaaaacctgccttgcatacatcgacggaatagttgataaaaaggttttaaaggaattaaaaaaaagaataaaaaaaatatacatcgactcagtgcttgatgtgaattatattttggaatccgtaaaagataacagattctccccttttaaaacagctggaacttatgaaaaacctgatgtcattgcaagtaaaatacttgaaggaagagttgctttatttgttgacggaacaccaatagtaatgactgttccctatttatttattgaaaattttatgtcgggcgacgattattatctaaattattattttgcttcttttacaagaatgataagaattataagctattttttatctatatgcatacctgcattatatatagcaataataacttttcataaagagattttgccaagttctcttgcaataagcataataggagcaagagaaggaatacctttttcaacttttaccgaatgcattcttatgataattatatttgaaattctcggtgaagcaggtaacagaagcggtagcggagcaacaactgctcttggtattgttggaggtattgttgttggacaggctgcagttgaagcaagacttataagcgctcctatgataatagtggtagctctttccgcaataagcgaactaatgattccaaatgtaaaaggttcaacaattatatttagatttatatttatctttctttcttcaatacttggattatacggatttaccattgcttttttactattaattgttcacttatcatcattaaaatcttttggtatgtcttatatggcaaatgttacattccagtcaatacaacaatttaaagattcattttacagatccccatggtacaaaatgataacaagacctaccgatatgtcagaaaaaaaagataggataaaataatatgaaaaataaaataatttctgttctttttttaataatatctctttgcatttttacttcctgttttgattatactgaacttgaaagagaaatacttatttttacaatagggatagataaaactcaaacaggatacgaagtaagcgcagaaacattgcagtctgaagattacgatggtcagctttctattaaaccgcaagttattacatcaacaggcgattcaatatatgatgcattaagcaaacttgatggtaaatttaacaacaaagtaaatttaagtcactgtgggcttattattgtaggagaagaatatgcaaaagaagacggaataaatgatatattaaatttagtatttgaagaaaataatttaagatttaatacaacatttacaacaacatataattcagcagcaaaggaaattttaaatacttcgtcagaaaacggaacttttcacggttttgaaatattagaacaattaagcaaaaataaattatttaataacagtgcaagagcatacaaagtaatcaactcaatagaaaatcaaggtattgaattaacattaccagtcataaaaaaaacaaatgaaaatgaaaaaaagaatttttatgcaaacaagattgcagtatttaaaagtgataaattacttggatatatagaagacaaagatgtaaactattattcttttctattaaacaaaaaagattcaatgcaattaaaattaaatattgataataacatagtaaacacaaagatatctttaaacaaaacaaaagataaaatagaaaatgataaattaaatataaacatggatataaatgcttatatgctttttagttgtttggttccattataattgatgttgttccatcttctaaatcgtttctagtatatgttactttataatcttcataagaaattttaccataacctatgccttcatcattgtacttatatttaattgaatttaatttatcccaaatttttttatttttactttgttcaaaattattatatccatcaaaaatattcatcgacatatttacataagctgaatatatttgatttatttcatctagtttatcactatcagttaatgtgaaaaattcatcataagacacaacaactttttctatacttttataatcttttgaagggtatatgtttatgtatagttcactttcatcatcgataattttctcatagcatcctttttcatcattaaatgttatttcaccgattgtaggtattgttactccatcaaagtcactataataaatattttcgtttatatagtctaatgttttagcaaaatcttcgggagatagttcaaaatagttatttatttctatgccattatatgcataatctttagagcttggaccgttatttccaaatagtgcaaagcaaactattaaggcaattattaaaataccagcaatggaaaatccaataatttttttatttttctttttgtttttatctttaattttttgcatttcttcttcaaaattgtaatgattttggttattaaaattataattttgttcataattagaagatgtatttatattttcgttttgttcattattattaaatttatcttcttgaatattgctgttttcttcttctattggttttttatttactataaattctcctttttcttctttagtatttagttcttcattaccttcttcatcaacttttttgtttacgataaattcgcccttttcgctgtttaaataatctttgttgctttcgttatccatttccatccctcactttataatattataaaattatcgaaacgttttaatatatattacattttatcataaaatttaataatattaataataaaattaaataaaacattattttataaaaaaagaacctaagtaggttcttttattttattattatattgttttttccgatgagttcagctagttcgtcaattaatccaaattcaagacttacccacatgcttttatcagcaacgtaagatttctttgaaacaggggagaataacacaacttttttatctcctttatatttaacaaagagctgtctaatatcactcatagttttcggacttattttatttaaaacaagtataagggattttcccattattttatttgagttggacttcttgatttcaggggactgagctgttttatcaattgttttgactattggtgcttttgttttctttcttacagcaggtggtcttgttcttttatcttcaaggtcgtaaattttatctgcaataatcgaaacgcttacttcttcatcttcttctttaacacttacttgacctttgattattactttgttgtcagtttgcaatatgtttttgtattcttcaaaggttcttgggaaaacaactatttccatgtcatcagtcaaatcttcaatactcataaacgccatttgtttattatctttttttgtatatattactttaacgtttgttattaaaccgccaatgcttatgctttctcttttattgttattatattttgagtatttattttgaacttttggttctatttcttcttcactttcatcttcatcttcactttttttcttgccgtacatatcatatacttcataaagtttcatgctagtatatttattaagatcctcttcaaactctcttaaaggatgtccacttatgtacattccaagaacttctttttcgtatttaagtttatcggcattctcaaattcactcattgtaggaatatgcatttcaatttgctcgttttcttcctgtgaaagcatatctagaagtgttgtttgtcctgatatattttgttttctttgttttaaagtgttatttaaaaattcttcataaatagtataaagttctcttctattgtttccaagtgaatcaaatgcacctgataaaataagactttcaacaccttttttatttaaggagtggaattcaattttatttacaaaatcagggaaggacgtaaaatctccttttgtttctcttgcttcaactatttcttctatggcaccttctccaagacctcttagagcaagtaaaccaaatcttacacttccgttatctaccgtaaatcttgcgtaactcttgtttacatcaggaggtaataactctattccttgttcttttaagtgattcatgtataacattctatcatcagaaccaatataaacagtaattagggcagccataaactcagcaggataatatgtttttaaatatgctgtttggtatgaaataacaccatatgccgcagcatgggatttgttaaatccgtaggaagcaaatttttccattaagtcatatatttcgttacctgttttttcgtctattccaattgcaacacatccgtgaactttttctttatcttcgcctttgttataagcttcttcgttaccgtgtaagaatacttctctttcttttgcgattacttcatgttttttcttacccatggctctacgaatgttatcactacgtcccatagagtatccggctaaatctctaactatctgcataacttgttcttgataaatgattataccatatgttacgtttaagataggttctagagatgggtgaagatatgtgatattttcagggttatgtttattttcaatgtatgtaggaatcatatccataggtcccggacgataaagggagatacccgctatgatatcttcaaaagtgtttggttttagcctttgcataaagttttgcattccagggcttgctaattggaatacacctattgtatctcctctgcttattgtgtcataaacgttttggtctttaaagctgatattatcaatatctacatcaatacctttggatagtttaatattatctaaagtatgtttaattaccgttagatttttaagtcccaaaaagtccattttaagtagccccaattcttcaaccgtaatcatgttgaattgtgcggctatactgtctttattaagatataggggaacataatcgctaacaggtctatcggatattataacccccgctgcatgagttgatgaatgtctaggcataccttctacggcttttgccgtatccaaaagcttagtaatagtagggtcttcatcgtataattgataaagctccggattcatttctattgctttttgaacagtaattttattttcatcaggaatcatttttgcaattttgtttgattgttcaaagctgattcccatacatcttgcaatatcttttacggcagcttttggttttaatgttccgaacgtaacaatttgacttacgttatcaaatccatatttatcaataacatactctattgctctatgacgattttcataacaaaagtcgatatcaatatcgggcattgataccctttctttatttaagaatctttcaaagataagagaatattttattgggtcaatttgtgtgatatctaaggtataactaacgatacttcctgcggcactaccccttcccggtcctaccggtataccatgtgttctggaataatttatgaagtcccaaacaataaggaaataatcgttaaaacccatatcgttaataacgcttaattcatattcaagtctttctgttagttcttttgtgacgtttttatattttttatataaaccctcggtgcataatttttttaaatattcctgtgaagtcatcccttcaggaagagggaatacaggtaagtgataatgtccaaactctatttcaacattacatctctcggcgattttatgagtgttttctatggcctcagggcaatatttaaaaagttcactcatttcttcaggggattttatataaaattcgtcatttgggaaacgaagtctgttttcatcatttaggttacttgaagattgcacacaaagaagaacatcatgtgcttctgcatctgatttttttaaataatgagagtcgtttgtggcaataagtcctacaccatactcttttgccattttaattaattcttcatttgcagttttttcttctctcaaaccatggtcttgaatttccaaaaagaaattgtctttaccgtaaatatctataaatttttcaaggtattttcttgcttcggcaatttctcctgaattgatttttcttggaataacacctgctatacatgcactggttgcaataataccttctgaatatttttcaagtaaatcaaaatctgctcttggtttatagtaaaaaccttctgtgtaagcaattgatacaattttcataaggtttttatatccaatatcattttcggctaataagataaggtgaaatctttgcctgtcgtttatcgggtctctgccttttctatctccgattgtcatatatacttcacatccaagaacaggttttatcccttcggctttacatgctctgtaaaaatctataataccaaacatattgccatgatcggtaattgcaatactgtccatacccatttctttaacgtattttggtagttcttttattctgcaaaatccatcgagtaatgagtattctgtatgtacatgtaaatgtgtaaatggtattgacattattttatctccttatcaaaaaactaaaatttattatataatattttagataaaattgaaataatatatatataaaaatatttataaatgaatgtatgtgtgatataattcccatatgtatttttaggagggaaaaaatgttgacacctaatccaatagcattttcagtctttggaattgaaataagatggtatgcaatatgtatactaacgggaatagttcttgctcttttagtaggttcaagaacactaaaaaaacttggtattgatactgatattatatatgattatttgatagtttgtctgcctcttggaattattggagcaagactttattatgtattatttgaatggtcttattatagtaatcatttatctgatatttataaaatatggaacggcggacttgccatccacggaggacttataggtgcttttataggtatatatttagtaagtagaagcaaaaaattaaatgtgcttttcattttggatatagtagctccttgtttcttgttagctcaaagtataggaagatggggaaacttctttaatatggaagctcacggcgtacagactactcttccttgggcaattaatgttattgatcctgttcttggttcaattatggttcatcctacattcctttatgaatcaatttgggattttctgggatttttacttttgtatttcataatagataagaagtttaagaaatatgatggtgaacttatttgttcttatttcatatattattccataggaagattttttatagaaggtttaagaactgattcacttatgatatttggtcttagaacagctcagcttgtaagtcttgcacttataattattggaatagttggaattgttataataagaaaaacacataaaaaagagaatataaaagacaaagcttatgagaatatttgtttagagaaaaatgaacaagataatgtaactgatataaatacagaaaaaatttgtgaagataataaaacagagaatataaaaagtaaagacaacttaggtaaggagtaattatggcacttatatcatcaacacagttatttaaaaaagcaaaagaagaaaaatatgctattccggcttttaactttgaaaatatggaaatggcaaaaggaataatcgaagcatgcagcgaagaaaattctcctgtaataatgcagacaacaacttcaactcttaagtatattgctcctgagatagcttatgaaatagtaaattattatgcgaaagaatataatattgatgttgttcttcatcttgatcatggagcaagttatgagctttgcaaaagatgtatagactcaggatatacttctgttatgattgacgggtcaaaacttgattttgaggaaaatattgctctatcaaagaaagttattgattatgcttcaaagtgtaatgttccagttgaatgtgaacttggcagagtaggaggaaaagaagacgaaataatagtaaatgataaagacgcacttctaaccgaccctgacaaagctttagaattttctgatagaacaaattgttcatctcttgcaattgcaataggaacggctcatggtttctataaaaaagctcctaatttagattttgaaagacttgataaaataaataaaatggttagtgttcctttggttctacatggtacaagcggaactaaagatgaagatgttaaaaaggcaataagtcttggaatgtgtaaagtaaattatgcaacggatttaagagctgcgtttacaaaaggtgtaagagattgtttaaaaatggaaaatgtatatgatccaaaagaatataataaagcgggaattgaaactttaaaattaagagtaaaagaacttattgaagtttgtggaagtaaaaataaggcttaataaattaaaaatatatattgacatttttacaaaatttgatataattttatagtgtcaaaaataggggtatagctcagttggtagagcagtggtctccaaaaccacgtgccgagggttcaagtccttctgcccctgccataaagaaatcaaatcggatttttatccgattttttttatttataaaatataaaacgaattaaaaaaataatataaaaagttatataaaaaaagcaggttaaacctgctttttattttttcagtagataaatatagaaactacaatctgctattttttcttcttctatagaaaaatctattgaagtaaagactattcttgtatttttatctatgtcatatattaactttttatctaaattatttttattgtttttatataattctttgaagtaattttctaagtcaatattaacgttgtatttatctatttttgttccttcaatatataattcatacatcttgttgtattcttttatgtttatttcttcattttcataatcatgataaaaagaaaaatattctgtattttcatcttcataatattcttcgtctacaaaatcagaaaattcatatgtttctttaaacttaaatccatataagttttctgtatcttttttttctattatgttttttacaaagtttgactttttaccgattgagactgtaagatattcatgggcgctttgtattttttctttatcttcttcgcttatattgtttgattttattatttcctctccctttatcatattattctctttgagaatgcttataagccttgcttcctggttaaaatttgaaatattatatatgtttaaaggtgtaagagtaaatataaatattatcaccgtagcttaccaatatttacatgtggtttagttctttcgtatttttctcttgccatttttatctttctccttaaaaatttaattattaattgtttaaaatagcttatttacatcaagtcaataatactaaatattgttatttatgtcaacgtttattatacaatatttattttatgatatacctttttacccttctttattatcatttcgttattgttaaaatcttccattgttatggctttgtttacgtctgttactttttcatcatttacgctgactccaccttgtttaataagtcttcttccttcgctttttgaagggattaattttgcttttaacattatgtcaagtagggtaggttcttcacttaattcatcttttgtaatatctgttgaaggtatgttttcactgcttacgcctcctttgaaaagtgcagttgcagcttcttttgccttgtcggcttcttctttaccatgaacaagttctgttaattcatatgctaatatctctttagctttattaagttcgcttccttgccatttttccatttctttgatttgttcaagaggaaggaatgtaagcatttttaagcatttgataacatcttcgtccgcaacgtttctccagtactgataaaaatcaaatggagatgttttgtttttatctaaccatacagcacctgatgctgttttacccattttctttccttctgagtttagaagaagagtaattgtcattgcataagcatctttgccaagttttcttctgataagttcggttccgccaagcatgttgctccattggtcgtctccgccaaattgcatattacagccataatctttgtatagtctgtaaaaatcatagctttgcattatcatgtagttaaattcaaggaagcttaagcctctttccattctttgcttataacattcaaatgataacattctgttaacgctgaaatgagaacctatatctcttatgaaatttatatagtttaagtctcttaaccaatcagcattatttaccattaatgctttaccgtcagaaaaatcaataaatctgctcatttgttgtttgaatttttcgcagttttcatttattgtttcaacgctcatcatttgtcttaaatcagttcttcctgatgggtcgccaatcataccagtaccgcctcctacaagagcgataggtttgtttcctgccatttgaagtcttttcattaggcaaagagccatgaagtgtcctacatgaagactatctgctgttgggtcaaatcctatataaaaagtggcttttccgttattaataagttcttttatttcttcttcatcggttacttgggctattaaacctctttcaaccagttcttcgtataaagtcattttcttttctccttaatatgctcttgcaaagtacgcaagtttatctgcttttttaccacagcatacgcatttatcacttccgatatcttcttgtttgaaaggtacacatcttagtgttgcgcctgtttcttctttgattttatcttcacattctctgcatccacaccacatagcttttacaaaaccaagagattcactttgaacttttttgaattcgtccatatcttttgcaacttttgtatgttcttctctgtgttttaaagctttgttaaatagattttgttgtatttcttcaagaagttcttttacttttgtttctacttcatcaagagaaacagatattttttctgaagtatctcttcttgcaattacacactcaccgttttcaatatctttaggtccgatttcaattcttacaggaacacctttcatttcccattgattgaatttccaaccaggtgaatatgagtcattatcatcaagtgttactctataatctttcaatctttcttttaattcgtttgctttatcaagtacgccttctttatgttgtgcaataggaatgataacaacttgtgttggtgcaatttttggtggaagtactaatccgtaatcatcaccatgaaccattattattccaccgattaatcttgttgatactccccaagatgttgagtatgcgtattgttctttttcttctttatttaaaaacttaatctcgaaagctttagcaaagtgatctccaaggttgtggcttgttccgctttgaagagcttgtccgtcatgcattaatgcttcgattgtgtatgtagcatgagcaccggcaaatttttctttttcagatttttgacctacaacaacaggcattgcaaggtaatcttcacagatttctctgtaaatatcaatcatttttaaagtttcttcttgtgcttcttcaaaagttgcgtgaactgtatgaccttcttgccataagaattcgcttgttctaaggaatggtcttgttgttttttcccatcttacaacgtttgcccattggttatataggaaaggaagttgtctataagattttaaccattttgcatacatactacatataattgtttcacttgtaggtctaacgcataatctttctgctaattcgttttctcctccgtgtgttacccatgcaacttcaggtgcgaatccttcaacgtgttctttttctttatttaaaaagctttccgggataagtaacgggaaatacatattttgatgtcctgtttctttaaatcttttatcaaaagcttgttgaatgttttcccatagtgcataaccataaggacgaataaccataaatccctttacgggggcatagtctaccatttccgttttagttattacatctgtgtaccaacgagcgaaatcttcacccattggggttatagcttctactttctttttcttacccattttctttttctcctacattttataattttaatcaattaaatattatagcataagtatttataaaatgcaccataatttacttttaaaaaccatgaaataaacattatttcttcttttaatgttttatattttaaaattaatgaagtgcatgtatgataagacattttacatttgatatttttatatgtttgattatatttgcatattggtctttacttatttatatgttatttaaccaaaaaggaaaaggagaggattaataatcctctccttttaaaaattgttcttttgttaatattttatcgttatctttttcgttttttatattatgatttttgttattttttattatgacttctcttacagtatcgtcattatttacaattacttttttcttttccatttttctgttcctctttctttttttatgtcttttattatgtacgtttgataaattcaaattctcatcattttgaatattattctcattatttaattttcttcttttcattttttctaccttgacttgtttttctttacataagattttaaaagagagagaactttttcaaattgttcctgctctttctttggtagtttttccttgtattcgagaattactcttgctttttcttcgttgcttaaattcgataaatctccgttttcttttaaaaactgtctaaatttcggagcgtattcttcttcaagtctttctgccttttccattactccttttctgtttgcttcatcttttaacttttcaaaagaactttcgttgatatttaggctgtttgccatatttatcatctttgaaacatctttttctttcaagttttaaacctcctttaattttaattttgaaataactttaattatttcatcacacaatcttatatagccgcgtactatgaattaggagcttaaaaaaagcacctattaaaatctattactcggaggtaatttatatgtgtaattttttagatgattgttcttgtgaatgtttattaatgtttttcttacttttggtagttttatttaatgactgtgaaatgttcggcgacgacccttgttcattactattcttcttcttactattaatcgttttatttactgaataatcagctgatagatatctttatcctattaatataaaggaggtactttcttttgaaaggtaattttttggattgtttgtgtgaagatgataatttaataattttaatcattcttgcaatgctatttttatgcggtgataataataatgattgtggctgcgggggaggtttcctaagaggcatatttgatggaaacaacataattcttattattttagtattatttttacttttctgtgatgatgagtgttaaaaaaaggggccttggccccttttaaaggagattaaatatggatagcccaaaaaacatatcatttggtgaaattctggttttaattttgctttactctgcatttgggggtggaaacaatacatcttacgtaaaagcaaaatatgtaattgaaaattccagggataatgacagttctattcaagctacaaataaataccataaaaacaagcatttatttacagataattttaatatacataatgtgcgaaaaaagctgaaatatgttgataattacttttctcatgcacaaaatataaaaaataaaactttaagaataaaaaaagagggaaaacaaggaacaaataaatttttaatggaaagtttaaagcattctcttggaagtgattttaataagatagaatcaatgataaatatgcttcctttgcttagcagtatgggagaattaaaaagtgtttttcttcctgaaaatattgataaaaatgaaaatgaaaaaattaatgttttagctgagcacaataataaagaaaaagattttaaaggaaataaagattttgaaaatattttggagcttgttgatttgctttcctaaagacattgcctgcaatgtcttttttatattttactttactatacttttctttactttactttgttgaaaactgcatgcaaattttaacatattgcatgcaatttcggtaaaactgcatgcaaaaaggctaaatttgaagtatttaaaattatcgggaaaatggataaaaattattatattgtcgtaaaattgttatttttttagatttgcaccgaatattcctcctacggcacaaagaaggataaataaaggtatttttaaaagaaaattaaaaaagttaaaattaccttgattaagaaaaatatttaaaacaagcataataaaaaggaaaattataccgtttaaaataccgtatagataaccgttttttgatacattttttcctgcgtaaagacttgaaataaacagccccaaattaagtaaaatataaagtccccctgattccacacttacggggaaatcaaaaaaatacataaaaagagaaaatacaaaaacactgataacgcagaatacacaccctatcattactccatttagaagtttttttatgttgttgttttttgtcatgatttttaatcctttcgtatattttatattaaatatttattattttattttttaattcattacaatatttgtttattatatgttaaaatttatttatatttttttaggggttttagaattggaatataaaatttttaaacaaaaaagttcagaaaacataaattatgattttatagaaaatttaaaagaacaatttgatatatcttatttgagtgctctcttgcttaacatgaaggggtttactacatttggagaagttgaaacttatctaaatcctaaaattgaagacttgtatgatccttttatgtttaaggatatgaaagtattcatggaaagattaaagagagtaattttaaataatgagagtgttgttatattttcagattatgactgtgatggggtaacttcaagcataatactttataaaattttgacttttatgaaaattaacgtgcaaatagttataccaaataggtttacaaacggttatggattaaataccgaaagtattgaaaaaataatttcaattaagcctgatttagttattacaactgataacggaattacgtctgttaaagaagttgaaattttaaaaagtgaaggtattgatgttgttattaccgaccaccatactccaccaaaagaactcccaaaggcttatggaataataaaccctaaagttgaatcagataattatccttttagtgaattatgtggggcaggggttgcttttaaaatagctcttggaataaaaaaatattttgagcttgattatgatataagtgaaattcttatttttgcaatggttggaacaatagtcgatatagtttctttaacaagtgaaaatagaataatagcatctcttggattaaaagcactaagaaatactaaaaataaagggcttgtatctttaataaaaaaagctgatttgaatatagataatataaactgtggtaatgtaagttttcaaataggtccgagaataaatgctgccggcagacttattgatgcaaatcttgcttgcaagcttttcttaacggatgatgacaacgaagtagatatactatcttctaaattatgtgaattaaataatgaacgaaaagatatcgaagaggaaatatttgctaaaagtgaagagtacatagaaaaaaacgaccttttaaataattcccttattttatttattttaggtgaagatttcaatgaaggggttatgggtgttgctgcaagtaaaatacaggaaaaatataaccgtcctgttgtgattatgacaaaatcagaagagggagttattaaagcttcatgtagaagtataacaggttttaatatatttgattgtttgaatgaaagcagggatttatttataaaatttggcggtcattctgctgctgctggatttagcataaaagatgaaaatcttgaaatacttataaaaaaatctaacaattatgcaaaagaaaagaaaatagaaaatctattttataaaagagtatattatgatacaacggcaataccatctaatttgaatattccatcagctatggagcttgaaaggtttgctccttttggaatcggtaactcaagaagtgtgctttgccttagaaatgtagtaattaatcatgcaagggcaataggtaaaaattttgaccacttaaaattaagtattttatataacgggaattattatgatgccataggtttttctatgggacactatgtaaacgagtatgattttacaaagacctttgatattgtgtttaatttatctataaattcatataagggaatagaaaaacttcagtttgagcttaaagatattgattatcacgatattaatttaagggattttgacaaagctaattattattactttataaataatcttaaattaaaagaatatttttatccatgtgaaaatgctttagagtatccttttgaaacagctatcgaagaatataaagataaagtgtttgtagtatattctaaagatacatttatcagacttaataaatttttaaagtataaaaaatatgattataatatttcttataataaattaaataagatagagggaaagattaatattttggttttacctatagaaaatataggtgaagatgttataatatcatctttattattacaaaaaggctctatttcttttccatatcctgtaattgtatattgtatataataatcatatttttttaattcatttattttatttaacatttttataggatatttagaccaaaaaacaataaaatctaaattactatcattaaactcaataagacttacatgttttttatttatagggtttctaacataaacatatccatcttttaacctatttaaaaaccaatcaaagtaataacaaggtatatctgttctcctgcttacactaagtatcatattctagcctctttaactttttattcattatttaaaatataacaaatattttgtttttttaccaaatttttattaatattgtattattttaaatttttttatataatagatgtaaattgtaaattaattaaataaattaattaaaaatttaatatataagtgaggtacaaaaatggactacaaaataaaaggttacaaacctgaaaaactttttaatttttttgaagaaataagcgcaaatcctcgtggttcaagcaatgaaaaaggtataagtgactatcttgttgaatttgcaaaagaaagaaatttatgggtttaccaagatgaattgtttaatgtaattataaaaaaacctgcaagtaaggatgcaaaaaataaagctccaataatgcttcaaggtcatactgacatggtttgcgaaaaaatttcaagttcaaatcatgatttcacaaaagacggtattgatattattgttaaagatggaataattactgcaaacggaactactcttggaggagataacggagctgccgttgctttaatgcttgcaattttagatgatgaaactctttctcatcctgatcttgaatgtgtatttacaacacaagaagaaacaggtcttggcggagctgatcatttagacaaatctcaaatcaatgcaaaaacaatgattaatcttgactctgaagaagaaggtatcgcaactgtaagctgtgcaggcggaatgagatttactttaagtaaagatattgttaaagaaaataaaagcggtacaattttaacagtaagcgtagacggtcttttaggcggacattcaggtatggatattaataaagaacgtcaaaatgcaaatatattgttagcaagattaataaatagagttattagtaatactgatacatatgttgcttcatttaacggcggtagtaaagacaatgcaatcccaagaagcagcgaagctaaattattaatagaaaataaagaagaagtaaataaagttgaagaaatagttaataaattatcaaaagaattttctgaagaacttgtaccttttgaacctgattttgttgttaatgttacaaaagaagaaggagaaactaacgtattaagtaaagaagatgcaacaaatcttgtaagtgctgtatacttagcgccaaacggagtattaaaaagaaatcttaaacaggacggatttgtagtaacatctctaaaccttggtgtagtaagcacaaacgataatgttgcaaaaattgtttttgctccaagaagttcagttgcttcattacaagacgatacaactgacagactttacttattagcaagaacatttggttttaattgtgatatcgcaggtgcttatcctggctggagttttaaagaagaatctccaattagagatacttttataaaaagttacaaagaattattcggtggagatttaaaaatcgaagctatccatgcaggattagaatgtggtttattctctgaatcaattgaaggtcttgatgcaattgcagttggacctacaatcagaggcgttcatacacctgatgaagaaattcctcttgattcatttgaaagattttatgaattattatgcgatgttctaaaaaaagaagcaaatgcttaaaaaattaatttaatattaaatattatcatcaaagctattcttaaatttaagaatagctttacgcatttttaataaagaattgtaaaaatttatcatttttaattgtaaattaataatatatttacttttatgtaaatttattatataattcagtttgattgtctataataaaattaaaagaaaggggttaaattatgtctgacaaacataacgattttaaaccgtatataccagcagataaagttgcacctgaatttacagttacatcaattcttattggtattatcttagcaatagtattcggtgctgcaaatgcttatcttggtcttagagttggtatgacaatctctgcatcaatcccagcggcagttatttctatgggtattatcagagttatcttacgccgtgattcaattcttgaaaacaacttggttcaaacaattggttcagccggtgaatctgttgccgcaggagctatctttacattacctgccttattcttatgggcaaacgaaggtattatttcagctccaagcataataacaattttccttatagcacttgttggtggtatccttggggtaattttcatggttccacttcgtcaagctttaattgttgaagaacacggagtattacctttcccagaaggaacagcttgtgctgaagttttacttgcgggagaagaaggaggaagcaaagcaagcactgtatttacaggtcttggtattgctgctttatataaattcattgctgatggaatgaaagttttcccaagtgaaatcggatatgatattaaaggttacgcaggttcggcaattggtatccaagtacttcctgcattagtaggtgttggatatatctgtggtccaaaaatttcaagctacatgcttgccggtggtacattatcatggtttgtaatcatgcctataattgctctattcggtgctgatgcaacaatcttccctggagatgttgttatttcatctttagcaccaagtgacttatggggtacatatgtaaaatacatcggtgccggtgcggttgctacaggtggtattataagcttaatcaaaagtttacctttaattgttaaaacattctctcaagctatgaagagtatgggtaaaaaagctacaagccaaaatacacttcgtacagaaatcgacataccaatgccaatattattaatattattattaattattgctgttgctatttggttacttccgatgttcccagttaacttccttggagcattaattatcgtaatcttcggtttcttctttgcaactgtttcatcaagaatggttggacttatcggttcatcaaacaacccagtttctggtatggctattgcaacattaattattgcaactattcttcttaaagctacaggaacaacaggtgttgatggtatggttggttctattgctatcggtgctattatctgtgttatcgcagctatcgccggagactgttctcaagacttaaaaacaggtttcattcttggtgctactcctaagaaacaacaaatcggtgaaatcatcggtgttatcgcttcagctgctgcaatcggttatgtattatacctattaaatgcagcatggggttacggttctgctgaaatccctgcaccacaagctaccatgatgcaaatgatagttgaaggtattatgaatgcacaattaccttgggctttaatctttgcaggtgccggtgttgcaatcgtaattgaaattttaggtgtacctgttttacctgttgcagttggtatgtacttaccattcagcttaagcgctggtatcatggcaggtggtcttgttcgtttagctatggataaaagaaaagtaagcgaagaagaaaagaaagaatctgttgaacgtggtacattatatacatctggtttaatcgccggtgaaggtttaatgggtgttgttcttgctgttcttgctgtagtaaacaaagcagaagcaatcgatgtttcaaaagcatttaacatcggtcaaataggaagtttagtagtatttgcactattaattgttacccttgtaatggtttgtttaaaaaagaaagaaaaaaaagaacaaaaataaatgattaaataataaaaagatgtaacttttcaaataagttacatctttttataaaaatgaaaggaactccataaatgagtaaatctaataaaaaaaataataattatcttgaatttattccaatcaaaaatcctcaaatggaatatgaaacagatgaaaatggtattgtaattataaaaaaagactgggttggtttttataataaaattgcacaaaaattttttcataaacctaaaaccagcaacatctctttagatgaatacggaagttttatttggtttaatatagatggtgaaagtacagtttatcaaatttcacaaaaattagatgctcattatccaaaaatggaaaaaagcttatctagattaattaaatttttggaaatccttcaaaatcataattttataacttggaaggagattgattaatgtcaatactacattatctaccatatttattattatttatggttgcaacaatgctaatttacggatggggactatggcgtgcatctcgacaacaaagagatttaatgaatatgttatattcaaaagccgtttcaaaaataaaaaaggcaatcaaacaaaaaggtcctttatcaaaaaaagaaatacaagaagtagtaaaaaatattcaggtaagccagcctttctctaaaaaccgtttgggcgtaacggataaagtaagttttacaacttctattctctcttttatgattgaaaatgatatgttaataaaagagaaagagaatggaagattcgtttataaactaaaataaaaagatatctcaagatatcttttttttataaagtttaaatatttaaaatacataaaaattttaattattcacttttaaaattcatatttatataattttagcataaattaattatataaactttaggagtgaaaaatgaaaattaattataaaaaacttcttttatcaattttaatacctcttcttgtaggaggggtgtcggcactatttacaaaaaatagtatggatatatataaaaatctaaatcaacctgtattatctcccccagggtttatttttcctattgtttggacgatattatatattttaatgggaatcagtgcatactttatatcattttttgatggagaagaagaagaaaatgctcaaaaaatatatattattcaactaattttaaattttatatggagcataatattcttcaattataataattttatactttcatttattattttaataatactatggctttttatcttaaaaatgattatatctttttataaaattaatcctattgcaggttatttgcaaatcccatatcttttatgggttacttttgcaggatacttaaatttcatgattattcttttaaattaaaaaaagcttcaattaagaagcttttttaccttaaaggaagtttaactatactatatttccctctaaaattctcatctccataaaaaatttttttctcttttaatttatatagtaaataatccatagtttttggagataatttttcaatagctggataatcagggaacctatttatttccggaaattttattccattttccgttattgcaaggtcaaatccaaaatattcaagctcgggaatatttcttgcaacatccaaaactgtctgttttatcttttcccagtttggcaaataaccttctatttttacattagtatcaggatgatataaacatggtttaatttcattatcttcaattatttttgcatcgtaaaattttcctgtttcaatatcaatttttgcaaacatcccccctgctcccatattatctacggcaccggttcttttagatccaaatctcatataagcattcccaatttgaggatttttaccatcttttttaaatacaatcattcgtattgtattaacagcacctgaatatatatttttaattacaggatgcatgtttatatattcagttattaagtattgattattaacatcttttaaaatattaagaacatcttctttttttgcttgttcatgattaagatagtatttaccgtctaaatattcaaatttataaaatccgtcaccatgagaaccttcatcgggttttaaagcaagtgattttttttcttttacaagtttaaaaatatcttcaaaagtatttgtatacccttcaggacaatccatcatagaaataactttattatttccattttttagaattatatggtaatagtattcaggaaaacaattattataatcagaacaaatatactttacggttattttatcttccatccattttctgtattcattatttatatgtcttaaccatctatactcaaaatcagaaatataattattataattctcatcatttattccatattgatgtaatctgtaagatataaaaccatgtttttttgcccatattttttctttaaatgtagtatccttatttgtaataaagtcttttaactgctctttgggaaattttattgaaagataaggaagtaaacctttcgggaaaaatagttttgcatatgtggctcttactttaagttttactttcttcattcccctttttgtttttaccgataagcctttatatgcttttcttttttgctcaactttatattttaaatattttgatgtttcaatactaaaaggaacagatttaggatattccggatgaccatcccaacttataattttaaacccatcatctgttatcattattttcaaaccaaaaaactcaagttcaggagcaaaatatcctatattttttacggtttctttaatctcattccaaaaaggaattttacttggaatagcataatcattatttggattttttgttttctttattctatttcctctatttatgcttacactatctgaaattttaccatttatagtatctatataagcatatacagtactttcaaaccattcttctttttcaatttcttttaattcttcatcattattatcttcttcgtataatttaaataaaatatcatcattattttcatcatcattcaaatcaatttcctctttaaacgatgtattttttttaatatcaatgttgttatttaagaatttatttttttcaaatgatatatatgcatctccgattttaggattatcacctttagagttaaatactattaaatttattaagcctccttcaaagaagcagaatttttccagatgatataaatatagttataccttataaagaaggttatgttgaaaaaatttgggcaagatcttttgattatataaaaaaagaaaatatttatattttatctttattgaaagattctgtttatgatgagaatttaaagaaagattctcttgttgcttgtaaatattttaataacggaaaaagtgaagttttgattttcttgggagttacagaaattttgtaaaatcatgtataatattgttattgtcatatattaaataatatgttattgtaataaatagtgaaaatttgaaaagttatgtttaggagtaattgttatgaaaatgtggtcaggaagatttgctgagcaaaatgcaaaagaagttgatatttttaataactctcttcattttgataaagtgttatataaatatgatattaaaggaagtatagctcatgtaaaaatgcttagcaaacaaggtataattacaaaagaagatgaaattaagcttgttgaagctttagaaaatttaatgaaagacatagacgagggaaaagttacttttaatgaagaatatgaagatattcacatggctgttgaaagtatcttaactgacagaataggggatagtgcaaagagaattcacacttgcagaagtcgtaacgatcaagtggctcttgatatgaagatgtatgttaaagctgaaataatggaagttatggggcttgtgaaaaatcttatttttacattacttgaaattgcaaaagataatacaaaaacaataatgcccggatatacacatatgcaaagagctcaaacagttacatttgcgcatcatctttgtgcttatgtagaaatgtttagaagagatatggatagacttaaagatgcatacaaaagaacaaacgttatgcctcttggggcaggtgcacttgcttgttctacatttgatatcgatagggattatgttgcaagtttacttgattttgacagcattactttaaattctcttgatactgtatctgacagagattatgtaattgagcttttagatgatttggctataataatgatgcatttatctcgttttaacgaagagattatttactgggctagtgatgagtttaaatttattactgtttcagataaatattctacaggttcatcaatgatgcctcaaaagaaaaaccctgatgttgcagagcttataagaggtaaaacaggcagggtttatggtaatttaatggcgatgttaacagttatgaaaggtcttcctcttgcttataacaaagatatgcaagaagataaagaatcaacttttgacagtgtagatacagtaaaacaatgtttaagcatatttactggaatgattgatacaataaccgtaaataaagatgtattaaaagatgcttgtgtaaacagctttatgaatgcaacagatgttgcggaatatttagttaaaaaaggatgtccatttagagatgcgcattttgtggttggtaatttagttggaaaatgtgtaagagaaaataaattccttcaagatttaaccttagatgaatttagagaacaaaatgagctttttgaagatgatatttacgaagtacttcatgttacaacgggaataaacaaaaagaatatgacagcatctccgaaagaagatatagttaaaaaatacatagaaaaaatacttgatgaaataaaataaaagacaacgtgatgttgtcttttttatttctaatattatggaaaagttttttattttgatttataattatataaaattatataatatttgtatttgaggtaataaaatgatttgcccaaaatgtggttatgataataacaggagaaatgattgttgcagtgagtgtggattttctttaaaagaaagaaaggtaataaataaaaacgacaataatattacatatgcagaattattaactaaacggtatatcagatataagacaattcaaaatatttcaggtatggtatttttaatttcatttatgactatgttttttgctattgattctgattatgatattatagagtttataggaactataggtatgttattgatattaccgtctttgtttttatatattatttttggaatagtaagatatatacaaaagaggaaaattacaaaagaacttgacaattaaaaaaagattattatataaaattttttatatggagaataagttatgaaaatattggttgcaatggattcctttaaggaaagtctatcttctcttgaagcagggaatgccgtaaaagaggggatacttagtgttgatgaaaatatagatgttgttgttaagtcttttgctgacggaggcgaaggcagtatagagtctgttatggaggatattaacggagaaaggattgatttaaaagtccataatcctttgggagaaataattgatagttattatgagattatggatgatactgcttttattgaaatggcaaaatgttctggacttgatttgatacctgaaagcgaaagagaccctatgattacttcgtctttcggggttggggaaatgattagagatgctattcgcagaggtattagaaattttgtagtatttattggtggaagtgctacaaatgacggcggatgtggcatgttaaaagccttaggatatagattttatgatgaatttaataatttaattcctgccggtggtggtaaactaaatagacttcattatattgatgaaagcagagctatggaagaaataaaagaatgtaaattcgttgtggcttctgatgttaaaaatccactttgtggagaagagggtgcaagtatggtttattctattcaaaaaggtgctgatgaaaaaatggcatttgatttagattacagccttaaaagacttgcaaaggaaacatatgataaatggggaatagattacagcaataaagaaggtgccggtgctgccggaggaatcgggtttgcttttatggcatttcttgggggtaaaattatttccggagtagatgctgttttagattattcaaagataaaagaagagataaaagattgtgattatgttataacaggggaaggtaaatttgatagacaatcttttatgggtaaagctgcggttagtctttgtataatggcaaaggaatataatgtgaaaacaatactgcttgcaggtagtgtcgaaagtgaagataagcttgacagtgagtttattgatggatatttttcaataattcataaacctatggaactggaagaactaactaaaaaagatactgcgtataaaaatttaaaaaatacagcaagacaaatttttaaagtgatagtttaaagcaggttttagcctgctttttttttgtataaaaaaaactctgaaaaatcagagtttaaatttcataaaaatggagctgatgataggacttgaacctacaacctgctgattacaaatcagctgctctaccgattgagccacatcagcaccgctcatataatatactaaattatttatgttttgtcaactattttattcttaaacttcaatatatttttataattaattaaaaatttttagatacaattattaatattattttactatatgtaagttttttaatatttatttttaaaatactattaaagttattaattggtattaaatatttgcaatagagataaaaagataacaattattatataaaaagtaaataaaaaaactctgaatactcagagttaaaaggcataaaaatggagctgatgataggacttgaacctacaacctgctgattacaaatcagctgctctaccgattgagccacatcagcaccgcctatataatatactaaattattttgcttttgtcaactgttttttttattttatttatttttatgttttattttaaatatagtttaaaaatcttgtaaaaagttgggacaaaatttttgggaaaacatggtataatgatatcgtaaaaaattataaatagcagctgttatatattaatcattcaaataaaagagtcaaagttaatttgctttggctcttttttgttgggaaggagaagggatgaaaaataaaactttactagttaataaaaagcgcattgatgtaagcgacgaagtttataaagcttactacaaagaaagagaacatgaacgatatctttataaaaaagcgaaagacaaagagtattcatatgaaaatatgaaggaaaatgggatacagtttgaatataatcagggtatgtatattcagtgtgaagacgaaataataaaaaaattagaaatagaaaaattgaatttaatacttaaagatttaagcaaagatgaaagaagacttgtttatctgtattattttgaaaataagacagaaaaggaaataagtcttctttttaatttgtctcaaaaggcaataaataaacgaaaaaataatattataaaaaaacttagaaatttttatcaaacaaggtacttaaatatataaaaatttccttaaagatatgaaagagaaatatttgacaattaaataatcgtatatttcaaagtagattttatatgttgcaaatttttaaattaaacgattgcttgtattgtcagaaaaggaggatagttatggttgagattaaatgtatttcaggcgatccattttatatggagtcaaagcttgaagaggctatgaatgaagggtttgaaataatagatattacaacaaatttgtatcatagcagtggcggagaaagaaaagagactacggcttatctaaaaaaagtaattaattagtttaaaagtatgaataaataaaaaataaaggcagttatatatagaaatagtttttaatgttatttatttcatactttttatataaaactttttcttagatattttaaggaaatgaattacgctgaatgtcagcgaaaacaacagaaaggagatgatttgtttatgtttgaagaaacgattgtgacagtaaaagaaaatcctattcaaagaaaagttcttatgattccaaaattcaggtttgatgaagtaaatgaaaaatataagcaaaataaaaaagatattttacttttgaaagaagaattaaagaaaaaagagaatgagaaaaatcttttactaaatgatataaaaaatattaaacaatcctatgaaaaagctctgattaacttacaggtaaaggagacatttgtggaaggtggaatattaaaaaaacaatatgaaacaataattccaaaaatgacctgcaaagaaaatgaaaagccagatttggcaaaagcaatagttgacttaataaaacaaacaaaagaaaaagaaaaggagatttaaaaaatggcaattagtacacaaggaacaaaattaaatattacaggaacaaaaggagaagaacctatcaatattgatgtagcgattaaatcattccctgatttaggagctgcaccggcagcaattgaagtaacttgcttatcagatgattcacaaaaattcatccctggtattaaaggtatggctgctatggaatttgttgcaaattatgatgcaaatgtttttgaacaattagttggcgcagaaggtgaagaattaacatataaaattaactttggtgaaacagaatattctttcacaggtaaacataacgcattaatcgtaggtgctggtttaaatgttgcagtagatatgaaagttgttgttttaccaagttcaaaaatttcaaaaagcattgcgtagataataaatatagaggaggaaactcctctataaaaaagtattttataaaatattttgaaaggaaaaaacaaaatgattattaacaataaaacatatacaatacctgatttgaattttaatgcaatttgtaaattggaagatatggggattgctttaactaatatggataaaatgattttatctactgtaagaggttttttagcactatgtatgaatggtgattttgaaaaagcgggaagcgaattggaagcacatcttgaaaatggaggttctcttgatgaaatactacaagagattaataatgcagtagaacaaagcggtttttttcaagctctcaacaagacagcgaagaaggaagcttaacaggtataaaaagaaaagaagaaaaatctaatataaaatctttaaaggattatattgaggaagaatatctcgttaatgcacttgccattggaattgattataatttattttggaagcttactcctaaggaagttacattttttgttaaagcatatgaaataaagaaaaaaaatgaaattgaaaaaatcaattttagttcatggataaatggtatttatatatctcatgctattgcaagtgttttaggagataataataaatatccaggtaagccttttgagatatttaatgaaaacaaagaagaagaaattaaaaataatgaagagattttcagtgcttatgttactatgtttaataatgaatttgaaaagaaagctaaataatatagctttcttttttagttattatatcttttgatgtattttatttgatttttgtttagcttaatatttaggtattcaaaaatagaggcataatctaatagtttgatatttgtatttatataactttttctaccatacccatgatacattttccgccaccgccacctgggttaacatcgttttctccgttttgaagaatttttattttattataatattacacaaaaactttgtcaataaatactcttcaaatcgaagaatatttattgacaaaatattgacaaaaaagtgacttttttatatgattgaaaaacaaggagttaacagtatgagcaagaaaggaatctcactaaaattaaaagaacttagaagaaagaataaattaacaatagaaaaagttaaatatcttttggaaaaaagagatataaatgttgcaataaaaacaatatacgggtgggaaagcggacaaagacttccaacccctgatatttttttaaatttatgcgatatatataatgttaatgatatcttagaagaatttgaagttggaaaaagaaaaaagaaagtaaatgacaatttaaaaatgatagcaagagaagacggaataagttacaattctcttagtaaatccgaactaaaaaaattaaaagaaactactgttttaattactgaagatgaataaaatagatttaaaaaattataaaagtatacaacatctggtttggtatattttaagagaaacaaaaacaaataaacttcctgttgatatcattcatatatgcaaggaattaaatataaaaataagatattacgataataataacgatatcgcaaaaacctataaagatggcttttcatgcataacagaagatgatgaaaaaataatcttttttaataaatccataaataattcttgtaggcatagatttacaatagcccatgagctggggcatattttgcttgaacacaataaagataaaactaaaacatacaacgaaatggaaacagaagcaaatatgtttgctataaggattctagcaccactttgcgttttaaaagaaatgaatatatcttctcctgaagaattatcccaattatgtaatatttctaaaactgcagggaaatatagatatgaaaggttacaaaaagcattaataaaaaataaattttatattaatccaaaagaaaaaaagattttacaacaatttaataattacataaacagtttttccagagatatttaataaaatatctctttttttaataaaaaaacaatgattaaaaccattgttttataattaattattaaaatatataaaataaaaaatataaatctttatattattatcattggtggagatggggggaatcgaacccccgtccaaaaccagctaaattaaactttctccgagtgcagtttgtcttaaaatttaacctaatactataaaacaaacaaaattatataaggcgagccttaattaatactatacattgtcaagacacccaacatataggtccctgcgaaagtgtgacaatcgttatatttcttgcaggtcagaaatacacgaccgcgctgcaactaggcagcgaaagataatctattgttatcgtttattttttaatttgcttattttaaagatgttaagctcatctactcgcttatttaacctcactaaccctgtcgaaaccattgcatccccgtttatctataactatttttaaggtttctagctatatcacgttttgcatctttttctttaagactttctcgtttgtcataaagctttttacctttacaaacagcgatatccattttaacataacttttactaaagtgcaaatttaaagggattaaagtatatccatcttttgtaagatagtcctttattttccttatttcccttttatttaaaagcagccttctttctcttaaaggatcgacattatttctgttaccaaattcataaggacttacatgcataccaattatatatatttcatttcctttagtaacatttgcataactatcttttaaattaactttaccgtttcttattgattttacttccgtacctttaagctcaatgcctgcttcatatttttctataacaaaatactcaaaatttgcctgtttatttctggcaattatttttttatcttctttatttttatttgcccccatattctacctacatacctataatattaaataaaattgcaaaataatgtaatattgtgcctgccaaaacaaataagtgccaaatagaatgcatatatttatatttagtcaaacaataaaatattacaccaacagtatacatcaatcctcctaaaattaaaagaactaatgttaaaagtgaaacagctgcaaccaaaggtttaattgcaaaaacaactgcccatcccataattaaatataaaactaaagatattttttcaaatttctttaaatttattgcatttaaaactatacctactattgcacttaaccatataacaacaaatatataccatccaacattttctcttaatgtatataaagtaaaaggtgtataagtaccggctataagtaaaaatattgtacaatggtcaaatactctaaaaatttcttttacacgacgattttggaaagaatgatataaagtagatgcaagatataaagaaaacatacttatgccgtaaataatgcttccaattacagcccacatattagcatacattgcactaaggactattaaaaccgtacatccagcaattgcaaaaaatacacctacaccgtgagataccgaattaaatatttcttccccaagggtgtatctttttattatatcttttttttcttcactcataaattttcctcttttcaaattaattttttctgcttgatagataaactgcaagatttcttaaaaaatcagcactttcatcaaaatctgaaatactttcaagagcaatatttaaaagttgttctactttttcatacgatttttctaatccataaacatacggatatgtcattttgtttctttcctcatccatccctacatttttacctaaagtttcactatcagataccacatctaagatatcatcaacaacttggaacattaatcctatagaatcagcatatttcttaaaagattccatcttttcttcatctgctcctcctataatggctccgcttaatatacaagctctaagaagtgcacctgttttattatcatgaataaaatcaagagtttcaccgtttggctcttttccttcacttatcatgtccataacctgacctgcaaccattccgtttatacctgcagcatcagcaataacttccatagcttccacatatcttgttatattatttgcttttttgcaatttttaatcatagtttcatatgcaagatttaataaactatcccctgcaagaagagccattgcctctccgtataaaacatgatttgtcggttttcctcttcttaactcatcatcatccatacatggtaaatcatcgtgaataagagaatatgtatgaatcatctctatcgcagccattaaaggatatgcttctcttatatctcccccaacagctttgcaagattccatcaaaagaataggtcttatccttttacctcctacaaataatgaataattaaaactttcaaatattattccaggcttaccttctttaatagtatatttatttaatatatcttcaacaaataattgtttttcttttaattctttctttatatccatgtttaagcctcttcgaaattttttataacagcttcaccgtctttttcatctacaaatatttttactttcttttctgcatccaaaagttcttcttttaactcttttattaaaattcctgcttcatcatataacttaacgctattatcaagtgtaattttagattcttccattaacttgcttatttcttcaagtcttgataatttttcttcaaatgtttttttatcactcattattttcaccttcaatactatttattgtagaaataaacttaccgtctttcattcttatttttataatatcgtttatacttgcttcactgacagaagtaattatgttatcattcttttcaactaccgcaaatcctctatctataacactttcaactgaaagagttttaactagtttttccaaagaatttaatttttgcttattaaaactaattttattgccaaatgataaatcaatgaaatcttttaaattatcaacatactgttccatattttcaatatatgcatttggtctttttattacaggtttatttattacattttctattctttgtttataagaatcaattaaattatttaaactgtttgtagcctttctttgatattcatcaattgtaaaaataatattatccaacggttcacttacgatttcacctgcaacagatggtgttggagctctaaaatctgccacaaaatcacatattgtaaagtctgtttcatgccctacagcagaaaccacaggaattttactgtcatatactgcttgagcaactactctttcattaaaagcccataattcctcaatgcttccgccacctcttcccgttattatcacatcagcaagattaagtctatttatatcgtatatcatttgagcaacgtcttctccgcttccctcaccttgaacaagtacagggcaaacaattatttcaatatttttatttcttctttttataacgcttattatatcccttactgctgcccccgtcttggatgttacaactgccactctactaataaatttaggtataggcttcttgatgttattatcaaaataaccttttaccttcaactcttcaagtaatttattatattcttcatataatcttcctatacccttttttttcatgctacggacatataattgataattaccgttcttttcaaaaacagacacattaccctctattataactttcatgccatctttaggctcaaaatccagagaatatgtgtctgctcgaaacataacgcaatttattttacctttattatcttttattgaaaaatataaatgtccggaagaatgtctcttataatttgaaacttccccctctacttttaaattagacaataattcatcataatcaagtaaagtcttaatatatctatttacatccgtgacggttaaaattacattatctatcattttaatcctcactatacccaaaaccatatcatctggtattggatactatattataatatattcatatacaagtcaataaatattaactaacttttttatatacactatttaataacccgtttacaaaacttgcctctttttcatctgagtatgtgtgagccaacccaacggcttcatttaaacctaccaaagcagggatatcgtcattatacataatttcaaaaacaccaagtcttaaaacggctattacatgatttgaaagtctttcaaacttccagccttttaaattttcttttattattccatcaatttcatcaagattatctaatatacctttaatggtctttttagcatactcaccttgagttccttttaaaccattatctgtaatcatttgttcatatctttcattaaaatcatcatggaaactcatttgaaaaataattttatatactaaatctcttgctacgtctcttttcaaaatttaacccctttaaaatatatttaacattctaatccttcaatatatatattaacttgaattacactataacctgtcatagattcaacagattgtttaacttttttcttaacttcatctgttaaatcaggtattattgctccgtattttataattaaagaaatatcaataataattttattaccacttattattgtttttacaccttttccaacattctttttaccaaatatttctccaatatctatacctccatatagaccgcttataccatcaacttctcttgtaacaagtcctactattgaagttatcacattatcacttatatttcatcaccttgttctaaggtttctcttaaagtaatgttttcatcaatatttttgctcataattgtacctccttttcgagaaataaacatatacatattagtaactcaattataacattattttattttatttcaaataattaatgaaaatttaaatatctataaaaattggtgtatttaaaggattatatgaaaaataaacaagtattattccaagtaaaataatactcattatacttattaatttcactttaactttatcattttgttcatcaagcaaaattttataactaaaactttgacttatacctacacaaatcaaaaagaaacaaaataaagttattaattttgattattttttaaaaaaaggaaaggtaaatattaaagttcatccttatagtctttcttttagatgttattcttggtatttatatggatattgtgagaatgaagaaaaatttaatgtatataatatagataaaatattaaatttaaatcaagttgaatgtttttttaagaagaaagaagacatagacgaaaagaaagaaatagacaaaatatttaaaaatagaaaaggtattaatgtagcaatattatttgataaaagtgtggaatacagattgttaaatgaatttggacaaggaagttatatgcactttttagacgataaattgatttttgaatatacttttcatgataaagattatttgttttcatggctgcttacttttgcagataaagcgaaacttatttatccaacaaaactacgtgaagatttcctttgtatgttaaataaaataaaagataattattctatggaaacataaaaaacagctttattagctgttttttactatatccaaaagttctttaaggctgtcaataaaataattagggttttctgtagataagtattcttttgtgttatatccgtatgttacgcttgcaactttaatatttgctttatgagcagaaacaatatcccttacttcatcacctacatataaaatttcatcatcttctaattttagttttttcttgattttatttattttaatttcctttgagaataaaggtgaagaaataataaaatccatattatttatattctcgtttttaagaaaattatttatattttttttcgtgtttgaagatataattcccatatattttaaattgctttttaaatttattaaaatatcttttatatcttcttcatatgggtccatagatttatgatgttctttcataagtttctgaccttttttcattagtgaaaaaatttttaaatatggaactccaaggtcttttgcaatattgtgaattggctgtctttttaattcgtcaatatactcatgtgtaatttctttataaccgtattttcttgcaatttgattgtatacaacaaatattacattctctgtattagctaatgttccatcaaagtcaaaaatgacacatttataactcatttgtgtttccttttccaaatcttattgtattttagtttattatatcacaatattataaaagttaaattacatttatattaactttctcttatttatgtttaaaataatggaatggtttattatatcacagtaagaaaaagtaagcgtgttttgtttgttatttgagattgtagaaatagtaaaaatattttgataggcattttctattgttcctttttgttttattattttccctctggattctttccttataaaataaacatcttcacctatattattttttataagattttttgcatatgaataagaatattttggtagcttcatctaaacctccttttatataaattattattgactttttcactttgttttaaccatttttttcttttgtttccacaaagtatcattaaaattaaagtaatattctttatttttttttactaatatggtaaacttttaatacgtgtagatattaactataaagagttaaaacacagggaggtcatgtttattcatgaaattgaaatgggttagtagacgaaatgaggaacaagaacttaataaagtctacagacaaattgtaaaaagagaaaataaatatcatatagctgaagaatcaacttatatacataaaaaagaaaatatatttaaaaaaattgcaggcggtaaaaaagtagaaaagaagccttcaaaaataagagagaagtatcaagatagttggctaaatagacaaattaatgaaataaaagaagatttgtcggatttaattttaagtattaaatattacattaaaaaattaaaatttggttttagagattttagagtttatgctaaaagccacttttttaatgttgttgttggattttttgtactaattattataggtgttggtgtatttacttacaataatttgtttgcttatgaagttgtatttaatggtactaaaataggggttgtaaaaaatgttgaagattttgaacaggctctaacaaatgtagatgcaaaccttacgaaatggtatggaagttcaaatgtattctatgaaaaatctataagttatcaaaaagtacctattgaaaatccaaatgatattttagatagtgatgattgtgaaaatgcaatatataatatgaacttacctcttttttgtaaaggtgcagtaattacggtaaatggagaagaagcagttagagttgcgtcaactcaagatgcaaaaactgttatttcaaatataggaagcatttatgaagaagagaatgaaaatgaaaaagtaatcaaaagcagtgaagtaaaagaagatttggaatataaagaaaaacttatttctatagattctgctatggaagttcatgaagcgatagaatacttaaacgatacttcagataataaagttgtaaataatgatgacagcaatattttaaatgctatagatgaagcaaaagaagggacaaacttagtaagtgctcttaattttagagcagatgatttcgcaacagacgagataagttcaaagccttctattacaataacaactgtaaaacaagtaacttataaagaagatgtagattataaaacaatatataaggatgattcaagcgtttatgtagggactacaaaagttactcaagaaggaaaagacggagaaaagaaagtaacggcagtaaatacatatgaaaatggagaagttgttgaaagtgatgttcaaagtgaggaaataattgaagattatactccaaaaattgttgcaagaggttcaaaacctcttcctcctacaacaagcagcggaacattcattatgcctgcaagcggtacgatatcagctttaaataaagcagggtctcatgcgggatataaagctgttgatattgcaaatcctaccggaactcctatttatgcatctgatacaggtatagttgttagagcaggatggtatgcaggatatggtaactgtgtggatattgatcatggtaatggatatttaacaagatatggtcataactcttcaattttagttactgtcggacaaaaagttcaacaaggtgaaaaaattgctttaatgggaagtacaggaaactcaacaggtccacattgtcactttgaaattcactataatggagttcaacaagttatattaaattattttgactatttaagaaacggactttatgtaaatgccttacaagaataattcaggagaaatgttttgattagtacaataataataattatttgtttagtggctgctgtattgcttcaagttatactatgcaaaaaagataatattcatatgggattaataattccaggaatatttattcttatcgctctagttatgagtttattagccggtggggatactctattaaaagtcaatacttttatgcagtgggtttctcctggtattgtggcacttgctatctatatttatataaaaaagaaaaaatatgacttaagaaagcaagaacatgaggaatacaaaaaaaatcaaaataataatttagttgatataaatgaaaatgaagtaattgaagtagaagctgaaataatagataaagaggaataaaatcggggggcaataagcctcccgttttttatatttaatatatattttaaattatgttggtttgtattataatgtaaacaaatatcttaggagatgaagattatgacattagaagaattctttatgaaatataagaaagttgctcttgcatatagtggaggaatagactcttcatatcttttatatatggcaaaaaaatataatgtagatgtaacggcgtattttgttaaaacagaattccagcctaattttgcaatgaaagattgtctaagatttgcaaaaaaggttgatgcagatttaaagataattgcacaaaatattattgataattctgatattgtaaataatagtagtaatagatgttatttttgcaagaagtattttatgaatcttataaaaaccaaggcaaaagaagacggatatgagatattaattgacggtactaacttttccgatgatgaatatgacagtcccggtacaaaagctttaagggagatgaatattttatcacctttaaaaatgtgcagtattacgcaaaaagatgtaatacaactatctcttaaggaagggcttgatattgaaaataaaaattcgtattcttgtcttgcaaccagagtatgtgaaggtgaaaaaataacaaaaaaaacttttatccaatattgaaaaactgaagcatatcttttttctttaagttttagagattttgatttatctgttacaaataatactgctgttataacggtaaagaaagatgatatggataatatttttgcatatagagataaaatcataattgcaatgtctccgatgtttgataatgtttacttaaatttaaacaataaaaaatagatagattttatattgggaggaaatatgaaacaaatttatgttaattgttctaatggtgcagactgcgaaagtatattatctgcattatatgatttatatgataataaaatagaatttttaaatgaaataaataattttaaaattggtgatataagaatttcttttaacgataggaaaataaataataatgtttttaaatgcataaacaaggataaaatagataatgttaataaagaaaaaaaaagtaatgacagctctaacgaagaagatttttctcttgacagtttatatgcatatgaagtaggttatgatgattatttaaaagaaagagccacaataaataataatgtaactaatgaaaataatgaaaaatcagattctgaaattatggattttcctttagacggactttatgcatatgaagtaggttatgatgattatttaaaagaaagaaataaatatcaaaaaaaagaacaggatgttaagcatgagcaaaataatgacttcccagtagacagcctttgtgcttttgagataggctatgatgattatttgaaggaaataataaagaatcatgaaaaagaacatgagcataatagtattttactaaatgaaattaataatattatagataagacgaatttagattttaatataaaagaagatataaaaaatatattttctattcttactttagctatggcaaaagtacaggggattgatgtaagtgaagttcattttcataaagataagattttttatgatattacttatgtatgtggggtagcatatttaataaataaattaaatgtaaaaaaagttatatcatcttttatttcagtaagtaatatgagtaacaatgcagatagcagttattatatcgcaaatgaaattttaaaaggaattcctgtacatgtaaaagaaaatacaaaaaatcttactccattagctgctgctattataaaatactattctgatgagtttataaaggatttaagtatagtttataataatatttgatatggagtaggggaaagtgaagatatccttgtagaagtatttattggggattataataatcaattaattccggaagataaggttatttctcttttagttgatttatctgatatgaacacaaatgaaattgattttgtatttgaaagattattacaatcaggagttttagatgtttatactataccaatacataagaaaaatggttattcaagcttaatggaagtcatattaaatcctgaagatgaagaatctattgttaaagaaatatttaagtatactaaggcctttgatataagaagaaaagaatatgatagatatgttttggataaaaaggttgaaaatatatatacgaaatatggtatggtaagatttaatattgcaaaaggatttggtgtaaataaagttgaacctgagattgaagatttaaaagaaatagcaaagcgagaaaatattactttggatgaaattgattttaaataaaaaaagaacatctttattgatgttcttttttatttatcatttactaaaattatattataggtcaaatatgtataaaaagaatatccggcaaaatatttgaaataaaaaatatttccattttacctgagtatcaaaacaaaggatacggagcaaagctaattaaatttatttttgaaatgtataagaaaaaagcaagtgtaatgattgtaggaacaggagaaacaaaaaaatcacttaaattttatcaaagccttggatttaaacctgttaaaagaataaaagattactttttaaataattacgaccatgaaatacacgaagataacataaaactaaaagatatgatttatctaaaaaaaatcctataaggagaaagccatgaaaataaataaaataacagctatgtactttagtgcaactgatacaacaaagaaaatatgtgaatatattgtagataaattaagtaaaaatttagaaatagaaaccaatataataaactttgcaaacaaaaatgaaagagaaaaaaattttgaatttgatagtgatgaacttcttatttttggaatacctacttatgcaggaagaattccaaacatactgcttccatttataacaaacaacattaaagggaacaatgctttatgcgttccgatagttttatttggaaatagaaattatgatgattcattaattgaacttagaaacattttggaatttaacaaccttcattctattgcagccggagcatttgtaggagaacattctttttcatatactcttgcaaaaggaagaccggacagtgaagattttaaagaagtagataaattatgtgatttaattttaaaaagaatagaaaaagaaaaaataactgatatttcacctgtaaatgtaaaaggagaaaaccctatacgtacatattacaaaccaagagacagaaaaggaaattttatagatataagaaaagtacttccaaaagtaaatcataaatgtgataattgtaagttatgcgtagaagtctgccctatgggttcaatagataaagacaacgtagcaaagtataataatatatgcataaaatgcggtgcatgtataaaaaaatgccctatgggtgcaagatattatgatgatgaaggatatttatatcataaaagcgaacttgaagaaatgtatcaaagaagagcagaaaacgaaatattttaaaagctgtggaaatccacagcttttttaaagcaagtcttctcttcttttctttgtctctttcagtgcttcttcattcatatattcttctatttttttatgatgtccgctaagtaaaacaggtggaactttaagccccataaactcttctggtcttgtatactgacttgcctcaagcattccattttcaaaactctcgtttttataactttcactgtttccaagaactccgtcaacatatcggcttactgtatccataaataccattgccgcaatatgccctcctgttaaaatataatcccctatacatatttcttcgtctacacaaaggtctatggctctctgatcgattccttcatagtgaccacataaaagtataacttcatcaagttttgcatattctttcgcaagagcactgttaaaaacttttcctcttggagaaaaatatataacgggaacatttctttgtttttttatgtccgttacacagtcataaacaggttctgctttcataagcattcctgctcctcccccgtaaatttcatcatctactcttctgtgtttatcctttgaataatctcttatatttatcgcatttatttcaagtttgttgttttttatccctcttcctataatgcccacatctttatatgcttctatcatctcaggataaagcgtaagtacattataaatcatgtgttctccctaataaactaaatttttcttatttattttaatatgttcatcttcaactatttcaagtatattttcttccaaagcaggtaacatttgttcctttccgtctattttaaatacatatatatcaactgcggcaggagttaaaacatcaaccattactcctatttcttccccgttttcatcaagaactttaagcccttttaaatcttcaataaaatattcaccttcatctaaatctacactgtcttctcttaatacttctataaaattattttttaacttttcagcaatatttctatcgtcgatttctttaagctttaaaataatatgatttttgtttattcttgcagataccgcattatattcttttccttttataaaacatcttttaagctctttaaatctattcatatcatcagttaaaggaagaacttttaactctccttttataccgtgtacattaaaaatctttccaattacaatattttctttcataattatccattccttgtattttttgtattattatattttatcaaaaataaaatttcttttccatatctataataaatattaataaaatatggtaaaatattatataacaatattgcatatggaggcataacaattatggacaaaagaatagaacaattagcacataatttagtcactttttcaaccaacgttcaaaaaggtgaaaaagttttaataaatgcaggcggaatagaagatacaagagatcttgtaaaagcacttgtaagggaagtttacaaagcaggaggtttcccttatcttaaacttactgactcaagtgtaaacagagaaatattaatgggagtaagcaaagaacagttagaattccaaaatgattatgaattatatcaaatgaaaggaatggatgcttatataggcgtaggctgcagcgcaaacgcaagtgaattaagcgatgttccaagtgaaaatatttctcttcaatcatctgtattaagacctgttttaagagaaagagtagacaactcaaaatgggttattttaagatatccaaacaattcaatggctcaaagtgcaaaaatgagcaaagaagcttttgaagattatttctttgatgtttgctgtcttgattattctaaaatggcaaaagcagtagaaccattaaaagaacttatggaaaaaacagataaagtaagaatagtaggaccaggaacagatcttacattctcaataaaaggaatgcctgctgttccatgctgtggaaatatgaatattcctgacggagaaatttatacagcacctataaaagacagcgtaaacggtactatttcttataacacaaaaagcgaccatttaggttttatatatgataatattaaactaacatttaaagacggaaaaattattgaagcaacttcaaacaataacgaaagaatcaatcaagttcttgatattgacgaaggagcaagatatgtaggtgaatttgctattggaattaacccatatataagcgaaccaatgcttgatacattattcgatgaaaaaatatcaggaagtattcacttcacaccaggatgttgttatgaagatgccgataacggaaacaaatcgtcacttcactgggaccttgttttaatccaaacagaagaaaaaggtggcggagaaatttattttgacgatgtactaatcagaaaaaacggtttatttataccggaagaattacaaggactaaaccctgaaaatctaaaataaccttattaattagggggaaattattatgaaaaaaattttaacagcaattttatcaatattaattttaataggaatatgcggctgtggctttacgcaacagcaagatgtagacatgactaaatacagctcaaacatcgaaaaatccgatagaattgatgtaatgaaaaatgaggaaaggttagatttaatttcgggacacaataatattgaagattttataacaagtctaaaaatagaagaatggagaatgaaagatttacctaaagactcaaaggtagatttagaatttattttatattcaacaaagaatcaagatgaagaagaaagtgcggattatgaatttgaagaaaaaggccgtatcttaacttatgaagattcaagatatttaacattcgaaattaataaaatacagttcaattttaaagttccaaaagaagttattgagtacttaaatacatttaaaaactaaaaaagacgagataaaatctcgtcttttttatgttggataaaaattagtcgtcgcatccgcaactattgcatgaaccacttgttgggaaaaagtccccaaatgctgaaatatcttcattaagaaaagtttcacagaagtttggagcacattcttcttctctgcattcgtcaggaagttcacagtaaccaaatgttggaactttaagacttactttagatattgcattaactacaataacaaaaccaagagtcattgaaatttgattaccacaagttttatttacacaatttgcttcaacaaaacattcacttactggagagaatcttccttgtcttacgaattttctgtttaaatcaaatattgtgcttacaggtattctaattttattatcggattgaacggtatttccgcacattggttttgcaggtaccgtaatagtacagcaatcgcattttcttctaagtactgcataaatagggatagcaacaacgcattttaatcttgcatgacattcatccatttctgtgaagaatggttcgcattcataatgctctatttcagaagcaccaaactgagcataaaggaatgtataatcagataaatcaccatttaattcaagttcaaaaggcatattttgcatacattctttttttgaacatccgtcatacaccttatcaacaattagacattccacacctcttgtatttctttcttccactttttattcctcctaaatttatgttcttatttgttttacactttataatatgaagattatcattttgtgttacttgtaaacgtgatataataaattttatgatgggaaatattaatttagtaacacaaattgaaaataaaaaacttgatgaagaacaaatagagtgcgtaaattccaaagaaagaaatatacttgcaattgcgggagcaggatgcggaaaaactacaacaattcttgcaagaataaaatatttgattcaggaagaaaaaattccgcctgagcaaatactcgtactgagttttacaaattcttcaactgatgaacttattgatagaatttcaaaaataacaaaagaaaaaataaatgtatgtactttccataaacttggtaaagatattatagataatgtacacagtggcgatataagtatatataaagatacaattgcaaaattcgtaaacgaatatatagatataaaattaaagacaaacgaatattttgcaatgtatgattttataatcaactattatcaggaatatataagctttttacagtttgaaaataaaaaagacgagcagaactatctttttaataaaggaattataagtcttgataatgaatataagatgacatatgaagaaaatgtcattgcaaattatctatatttaaacaacatcgaatatgaatattttaatacgaatatatacggaaacgaatttaaaaaattatgctcaggtttttatcttacgaaatatgataaatttatatttaatataaatacatcatatgtagcttttttaggtatattcttttttactaaccttccagctaattttctgtatgatttatgttttacaaaagaattttcttttttcaaattaaagacaagcaaatcatcacatttttttacaatttcagtatacgtatttatgaacatatccatatttcttgttgaaataaaaagatatacaataattaacgaaggcacaactgtgaaaataaaacaataaaatgcaataaaaaacatatacataatatctaacatatcaatacacctcattttatatctataaaaatattgtattataaatataaaaattcttcaataaaaaaactcctctatggagttttatacaacttgtttattttcccattttgaacctctgtatcttattataaagaaaatagatcttactacccaatcaagtatcattgcaatccaaacgccaaaaacaccaaatcccatatacttacccaaaatataactgaatataattctgcatacccacattgatacaatagaaacaatcatacaatatttgacatcaccggcagctcttaatgcagatgggatattaaaagcagtaggccaaattataatcgcacaacatccatgtaaaattaaaattttgcttgcttccaatgcagttatatcagataaattatatgctttaagtatcaaaggtaaaattaaaaaaataaataataccaatatagctacacaaacataagttatctttaataattttcttgtataatatcttgcctgtttatattcccctgcgccaacacaccttgaaataacggtagtaatagcaagagaaacagccattcctgataaaatttggaatgaagcaactacatttgcaacggcattggctgctattgcatatgtgccaaatgtagataccaaacttaaaactattattttaccaagttgaaacatactgttttcaagcccgtttggaacacctatgtataaaatactttttatcatatcaaatcgtggtttatatttaaaacttctttttatatataaagtattatttttatttaaaagaagaacaacaataaccacagctgcaacaattcttgaaaccaaagttggtattgcgacaccggcagtaccaaaatgaaaaatataaataagtattgcattaccgcatacattaatcaaattcattaacatagaaactttcatagaaactttggaattacccattgaacgaaatatagccgctcctgcattatataatgcaataaaaggaattgaagcacttacgataagcaaatatgtatttgcatgtcccataacttctgcatcaatactgccaaatactttagttaaaataaactgtttcaatatatacataaaaatcataataaatacagccaatatagttataaaccagacaagctgtgttgatgattcacatgcgttttctctatctcttttacccaaatactgtccgcatacaacagctcctccagttgcaagagcagcaaaaatatttatcaaaagaatcattacactgtcaactaaagaaactcctgatacggcggcttctcctacactggctatcataatagaatccgccatacctaccaaaatagccaaaaattgctctacaataagcggaacaattaaaatcattaatgctttatttgaaaataaaaaatcctttgtgtcgatcttttttctgctaaataccatattaaaacccctatgtaaataaaatgaaaatactaatgaaaaaatttataaaatatttgtaaaattttgtaacctattatacaactataatacaaaataataaaccctttttatatttttcataaaaaaaagtaaaggttacttaacctttactttttttacagaagagaatgaagaataaactttctttcctcctacaactttatatgctctaactttataataatatgtctttttagatgttaattttgtttttgtataacttgtactttttgttgtttttgtaagaacatatttacctttactattttttgtatatatttgatatccgcttgcacctgaaactttattccattttatgtatgctttcttcttacctgcagaaactttaatactcgtactttttaaaacaggtttgacttttacagtattatatttgctcttaacaagtccattggaattattatatgcaacaactctataatagtaataactgttacatgtcaaagaagaatttatataataattatatttactgcttacagtctttataagtttataatttttactttttgcatcatatctataaatataatatccctgtgcattgcttaccttattccatgtaagtttaacagcattataattataacttacaccttttgcttttacttatgataaaactacttttggcttttcaacggtcgtatcatcttttggagggtcaactgtcgtatttccgccttctgaagagccaccttctccatttccggtatttgtattatcatctttattcaaatactcgttatatttaaccaacgttttatattttacactatctcccaaataagcatatatcttatcacttcctagtataaaagacatagaacttgcatttgaataaatgttgctgccaactttattccatgaagaatctttataactatacattttagcaacaccatttgaatcaacaacacctaaatacaaatcaccatcttttatatcaaatgaaatactatttaccttttcttcaaaagttgctactttatcagtactccaagatttaccgtctgcacttactgcaatattcgtcttgtttgacgatgtattataagtaaatgcatatatattatcttctgaaacaacaaacttctggaaatgatttgcggaagaattcacattataaactttttcaaatccgttatttgtttgtttataaatgattccgccttcatttttattttgaaaatcagataacattacataaagttcatttttatacagagccatacttggtgccattaaatatttacaatcagttattttaccaactgttaaaaactcacttccattccatttcataacagtaacattggtattatccaagtcgtataaacagtataactctccgtttaaatttatggcatatggaacgtttgcataacttccatttgtacttattctgcttttttctatccaattaccattttcatatttttttaatacaacactctctttttttgatgaataatcagcataaaaaacataaacttcattatttaaaataacaagattaccattgtttacattactgtcaactatacccaatgatgaatatacaccatctttatattgatatactttatttttatttaaaaaatataaagtattacctatttgtccaattgattttgcattatcgctatctgcaaaataatttgtatttaaagatgtatcagtcaaatccgaccatagattttcacttgaataatcaggaattgttatatcaaatataatataatcatcgacctgtgatgtaactttaagttgaattctactattaacatcatttgtatagacaagtgcattatcttttatagttgcattttcatcactgctacctatctcacttctttttccgtcactcagtgataatacagcattatttatatctccagcaaaatcatttatacctgtatcattaggtctaaatacataaatataatttttattgttaaaattacttttttcactatcgcttaaagcatcgtttaccctgtaacatacaagacccgaataaggaatttgactatccacattatttgaatcacttatttttgttttttttctatattcaaaaacaaaatattcattatcctttagaggagttttaaccataacggcattatctcctttatttgaatatggagcataaagagtaacactttttgttccgcttccagaaatatcttttattgtatcaaaacctaacatttttcttgtttgcgccaatggataagacggagcactccctactttagacattacatcataaggacctacaggagttttgctgctgtctttactatacaaatcaagtacaccaagagaatgtaaaaactcatgtaccattgttggaataagattacttgcttgagtattcaaaacattgtaatttaatatactcttacctgctattgtaaaattataattattgttatctgccttatgaggccaaatcacatctgaattgtctttaggtgcattttctttatctatttgtacgacaatggttaaattatcaatataaccatcactgtttttgtctacttcgcttgaattaatactattttcaaattcttccatttttaatagacattcatttaataaagcctgagaactgttatattctgatttgtttttatcaagagtaatatatgttatcttcatttttttgaggaaaataagaccttacgtttaattgtccgtttgataaaatatttaaatatttttcaaatgaatttggtatatagctatctgagttatcattaacttggttttcaaaataagtaaatttcgaatattttgcattatatgtataatcttcattatatgtttctttcgtatcatctttaaatttaacaataaagacgagattccccatttctttatttgctgcattaatgtttggtacaaataaagataaacttacaaataatatcattaaaaaagttaatattcttttaaacttcataataatccccttacaaattatattcattctaatttatttcggatattctactatatataatattaaaaagcaagtaatttataaaaaaacagctaaaagctgttttatattgatagatcttttttacagaatacttttatccctatacaaaataataatataccgataacataaagtattatggcaaataaaactccccaaatattaccttctataatctttgttgtatcaaataatgtaagtggagtaaggtattttaagtatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagtccaaatacaccacaattaatcaagagaaatttaggtatatcaagttctccattaaacataacctgacttaaaataataattaatgaagatatgtatataaccaaaataagtaacataaaaatcataacaaataaccaagaaaaaattatcttaaatctactgtttggtgtagataaaatataagataaagatcctttatcggtatattttacaataagtctattggttaatattcctataaaaacaagagggaaagcaataaacaagaacccatataaataattacaaataaattcaattaatgatgtacccggattagagcggatagctggataagcatacgagaagaagtcaatgaaaaaaaatgacaaaaaaagttaaaaaagtagttgacaagagattgagtatgtggtattataattcagctgactctgaaagaggcggcgagataataagacaaaagaataaaagagaaaaagatgatatgaattgctatatgcaaatttagtcagtgagatttgagtaaagagtcggattaagatttaagatgtaaacaatcgaccgagaggttgatgcgataaattatattgagagtttgatcctggctcaggacgaacgctggcggcgtgcttaacacatgcaagtcgaacgagaagcttatgattgattcttcggaagatttcataagcggaaagtggcgaacgggtgagtaacgcgtaggtaaccaacctcatacagggggatagcccagggaaacttggattaaacccgcataagaccacgctatcgcatgataaagtggtaaaaactccggtggtatgagacggacctgcgtcttattaggtagttggtgagataacggcccaccaagccgacgatgagtagccgacctgagagggtgatcggccacattgggactgagacacggcccagactcctacgggaggcagcagtggggaatattgcgcaatgggggcaaccctgacgcagcaacgccgcgtgagcgatgaaggttttcggatcgtaaagctctgttctgagggaagataatgacggtacctcaggagaaagccccggctaactacgtgccagcagccgcggtaatacgtagggggcaagcgttgtccggattcactgggcgtaaagagcacgtaggcggttaattaagtcaggtgtgaaagttttcggctcaaccggaaaagtgcacttgaaactggataacttgagtatcggagaggtaagcggaattcctagtgtagcggtgaaatgcgtagagattaggaagaacaccggtggcgaaggcggcttactggacgataactgacgctgaggtgcgaaagcgtggggagcgaacaggattagataccctggtagtccacgccgtaaacgatgaatactaggtgttggggtaactcagtgccgcagttaacacattaagtattccgcctggggagtacgctcgcaagagtgaaactcaaaggaattgacgggggcccgcacaagcagcggagcatgtggtttaattcgaagcaacgcgaagaaccttaccaggtcttgacatcctttgaccgtctaagagattagactttccttcgggacaaagagacaggtggtgcatggttgtcgtcagctcgtgtcgtgagatgttgggttaagtcccgcaacgagcgcaacccttgtgtttagttactaacattcagttgaggactctagacagactgcccttgaaagagggaggaaggtggggacgacgtcaaatcatcatgccccttacgacctgggctacacacgtgctacaatggtctgtacaaagggttgcgaagcagtgatgccaagctaatctcaaaaagcagatctcagttcggattgcaggctgcaactcgcctgcatgaagtcggagttgctagtaatcgcgaatcagaatgtcgcggtgaatgcgttcccgggccttgtacacaccgcccgtcacaccacgagagttggtaacacccgaagccagtgagctaaccgtaaggaggcagctgtcgaaggtgggatcagtaattggggtgaagtcgtaacaaggtagccgtatcggaaggtgcggctggatcacctcctttctaagagtagaaaagagactcgactcaaatctttctcttttaatctattgtaaaattgaatgaccaactaatgggggtgtagctcagttgggagagcacctgccttgcaagcagggggtcaggagttcgaatctcctcatctccaccatatatgaaaatgtgtgggggcttgtagctcaggtggttagagcgcacgcctgataagcgtgaggtcggaggttcgagtcctcccaggcccaccatgaagtttaaggattaaaagtaaggtattagaaatagtatcttagttttaactcttaaagagttgagagataattgaaaattgcataagtagaaaacacgaaaacaagtatgattacgaaacgacaaagaaaagaaagtttggttaaaaactataatttcaagacattttgtaagaatatatcttaggatcaagttattaagggcataaggtgaatgccttggcatccagagccgatgaaggacgtgataagctgcgataagctacgttaagctgcaaataagctttgaggcgtagatttccgaatggggcaacccactatgtgaagacatagtaccaccaggtgaatatatagtctggtaggagggaacccggcgaactgaaccatctaagtagccggaggaagagaaagaaacatcgattctcctagtagcggcgagcgaacggggaccagcccgtgtattgagagatataatgtttagctaaagtgtatgggaaggcacaccaaagaaggttacagtcctgtaagcgaaaagcattatgtagtagatacaccaagcgagtaccacgggacacgtgaaaccctgtgggaatatgggaggcccacctcccaaggctaaatactactggatgaccgatagagaatagtaccgtgagggaaaggtgaaaagtaccccgggaggggagtgaaatagaacctgaaaccttatgcctacaagcagccagagcgcaagtgatggtgtgctttttgtagaacgagccagcgagttacggtgtgtagcgaggttaagctgttcagcagcgaagccgcagggaaaccgagtctgaatagggcgaaagttgcatgctgtagacccgaaaccgtgtgatctacccatgtccagagtgaagcgaaggtaaaacttcgtggaggctcgaaccggtgtctgtgaaaaaggctcggatgaggtgtgggtaggggagaaattccaatcgaacacggagatagctggttctccccgaaatagctttagggctagcgtgtgacgatgaataatggaggtagagcactgaattggctagggggcgtattgcttactgaaccttatcaaactccgaatgccatatattttagtcatgcagtcagactgtgaaagataagttccatggtcgaaagggaaacagcccagatcttcagctaaggtcccaaaattcagattaagtgggaaaggatgtataattgctaagacagccaggacgttggcttagaagcagccattcatttaaagagtgcgtaatagctcactggtcgagtgattatgcgccgaaaataaccggggctaaaatctgataccgaagctaaggattagtttatactagtggtaggggagcattgtgtaaagggtgaagccgaaacgtaagtatccggtggacgttacacaagagagaatgctggcatgagtagcgaaagtgcagtgagaatctgtaccatcgaaaacctaaggtttcccgggcaaggttcgtccccccggggttagtcgggacctaaggcgaggccgaaaggcgtagtcgatggacaactggttgatattccagtaccgaatatgtttgtttgagagatggagtgacacaggaggataggttatcccagctgttggaaatgctgggtcaagcagtgagggtgttaagtaggcaaatccgcttaacgtaagcctgggctgtgatgagtaccgaaatatagtagggaagtagctgatttcacactggcgagaaaagcttctattgagaacatatttgcccgtaccgtaaaccgacacaggtaggtgaggagagaatcctaagatgagcgagagaagtgttgttaaggaactcggcaaaatcaccccgtaagttcgcgagaaggggtccctgtgagagcagggcgcagtgaaaaggtccaggcgactgtttaccaaaaacacaggtctatgcaaaatcgaaagatgaagtatatgggctgacgcctgcccggtgctggaaggttaaggggatctgttagcttcggcgaagcagtgaacttaagccccagtaaacggcggccgtaactataacggtcctaaggtagcgaaattcctcgtcaggtaagttctgacccgcacgaaaggcgtaacgatctggacactgtctcgacaacacactcggtgaaattgtagtaccggtaaagatgccggttacccgcgaccggacggaaagaccccgtagagctttactatagcttggcactgaatttcggtattgtatgtacaggataggtgggagacttagaagctaggacgccagtcttggtggagtcgacctttggataccacccttataatgctggaattctaacctgataccgtaatccggtatagggacactgtcaggtgggtagtttgactggggcggtcgcctcctaaagagtagcggaggcgcccaaaggttccctcaaaatggttggaaaccatttattagagtgtaaaggcagaagggagcttgactgcgagacagacacgtcgagcaggtacgaaagtagggcttagtgatccggcggttccgagtggaagggccgtcgcttaacggataaaagttacctcggggataacaggcttatctcccccaagagtccacatcgacggggaggtttggcacctcgatgtcggctcgtcgcatcctggagctgaagcaggttccaagggttgggctgttcgcccattaaagcggcacgcgagctgggttcagaacgtcgtgagacagttcggtccctatccgtcgtgggcgtaggatacttgagaggagctacccctagtacgagaggaccggggcggactaacctctggtgcaccggttgtcacgccagtggcatagccgggtagctaagttgggacgggataagcactgaaggcatctaagtgcgaagcccccctcaagattaggtatcccattctttgtgaagtaagagccctgatagactatcaggttgataggtcgcatgtgtaagtacagtaatgtattcagctgagcgatactaattgctcgaggacttgatctaaagatatatgaacttgttaaagaacttatgcaatttataattatctcttaatgaagagttaaatgaaatagtttaattcctcgtgacgatagcgacggtgtaacacctgtaaacattccgaacacagaagttaagcccgtccacgcctagagtacttgtctggagacggactgggagggtaggtagtcgcggggtttttttaaaggtactattaataaattacctataatacttatgatagaaaccgtaccaaatgaattaagtataataggtatagtaaacaaatatgcagatatacttacagaaaataatcctacaacatttttcttaaacctgctttcttcataaaacatttcaagaattttaaattgtattacaggtgcaagtaatataatacctattacagcactaaaagataataaaaaacttacattaaataaatttagaggattaatcataagcaatattattgctataataaatatattattaaaagcatcattatctttttcatgttttagggataataactcatttaaaatacacaaaaacattgctctaagagctgaaacagacatacccgcaagcataacatacataaataatattggagcaacaattaatgctctatattttttatttatgttaaacatggaaattataaataaaataacaccataaataagtcctacatgcaatccagatactgcaagcacatgacttaatccaacagcattaaagtcttcagtagtctcttcacttaaacttttatcagagaacattatgcccataattaaatttacattttcttcatcatcaatatttttaagtaaatttaatttaaaactatctcttatttcaaaaattttatctaaatagaaaatcagatgcccgcttttattaaattcaactttatttgtatttacatttatataattataaatgcctatggtttttaaatataaattataatcaaaatcatcaaaagcttttggagtttttaccttacctgtaaatttataataatctccaacattatatgtatgatagtcataataaacgtttattaatactttatcttttatatgtacagtttttccttcatcaaaaatatttatgtctttgacataaagctgcgttttatcttctttataaacaggcgctttaacaatttttgccgtgaatgttatatttttctcagcatacttatttaattcactgttataattaagcttataatttgcatgaataaaagtaataagtccaaatattacacaaataacaaaaatagctctcaaagaattattaggaaaaagtttaaataaaacaagacacgacaaagccagccctaaaatataaattaaaacagggcatttcaaatacgctgataaaatagaacataaaacatataaaaaaagaactattgccggtcttttaatatccataaatatctacctttttttaaattcgttattaataattttaacataaatattaataaatttcttaaaaaaataaaaaagggtatataaataccctttttatattatgcctaaagtttttattatattgatattacccattactccataaagcaagctttcttcatcaaaattaaagttaacactatgaagaggatttacatatcctttatcttcttctcttattccaagttcataaaagaatgaaggaacttcttcactgtaaaaagagaaatcttcagcacttaaaatagcatctcccaaaatataatcatcaccaaatgcaggcacaactttatcgtaaagttctttatcgttataagttataccataaaaaggtctccaatcatatgtgattttacatccataagcttcgcttaatccatctgctaatgtatgcattctcttatctataatattataagtatttttatcaagagttcttattgtaccttccatttcaacgtgttcggcaataatattaattctatctccacctttaatagtacctattgtaataagtccttctttaattggattaatatttctacttacaatactttgaattccatttatatattgtgctgcaataacaatagagtcaacaccgttatgaggagcagctccatgtgaagctttaccgtctataaatacagtaaattctgttgaagcagcatagaagccataaggttttgatgaatatttcccttttgggatgtttggactaagatgaagagcaaaaacatttttaacattatatttttttaattttccttctttaataataagttttgctcccccgggtccttcttctgccggttgaaaaatcaacaatatattttttttaagtttatctttattttctgataaatattttgcaaatacaagaagtatagccatatgaccatcatgaccacaagcatgcatcatattacaatgtttacttttaaaatcaatatcattattttcttccatacttagaccgtccatatcgctacggaatgcgtaagtttcttcgctgcctgcatttataaaacataaaacaccggtattagctgtttcttcatatttaaaacctaagtttgaaagataagtttttatatatttgcttgtttcaaattcctttaatccttcttctggaatttgatgtaaatctcttcttatttttgttatttcttcaaaatatttttctttaatctgttcaaacatttttttctccaagatataaattattctgtctttgtttcatcagtatttgattttgtattagtttttgtttcatctgttttttcttcatttgcccatggaagagtttctgaatattctctataaacagtatgaacagttctgccttttgaatcagtattatacaaatgtaataaattagccccaggatcgtaattaaaagtatattctatagtcccatccccgcttgttgcagtaaattttccatcagctactccgcttattgtatatgtagtagttgtaggtgaaccttcttttttggtaacagtaacaaccattgaagattcgtcaataaccatatctgtttttgtttcatctgaaatctttttcgcatgagaatcttgataaatactatcaagtgtccatttattttcgatatctgaaaaatcagtcgaatgttccttaggctctgtaccgcaaccgaacagagaaaaaagtaataaagtagtaattaaaatgcttaatattttttttgttgttttcatataatcgtacctcatatttgtttgtgatatattgtatcataaagataagaatattttaaaacatttttattaaaatttaattaacttatctattgttccgcctcctaaacatacatcgccatcataaaacacaccaatttgtcccggagtaacaccactttgttcctcgtcaaaaataacttttactgttttttcatccaaaacttcaaccgttactttttttaatggctgtaaatgtctaaatcttaaatcacatctaaatttcttagcaggaaattctccagaaaccatatttacatctgttgcaataaaaccatttttatataatttaggatttttatctccttgaacaatatataatatattattttctaaatccttatcagcaacataccatctttctccgcttccacatccgcctaccccaagacctcttctttgtcccaaagtatagtacattaaacctatatgttcacccttcttttctccggtgtccatatcaatcatatcacctttttggttaggcaaataattttgtaggaaatttgtaaaatttctctctcctataaaacatattccggtagaatcttttttctttgcgtttctaaatccttctctttcagctatttttcttacttgtgatttttccaaatctcctattgggaaaataactctttcaagctgttttgaacttaataaagaaaggaaatacgtttggtctttatgtaggtcttttgcttttaaaagttttgttccgttttctgtatgttcaaccttagcataatgtcccgttgcaatataatctgcatcaagaacattcattgcataatctaaaaaacacttaaatttaatttctttattacataatacatcgggattaggtgttctgccttttttatattcatctaaaaagtaagtaaatacattatcccaatattcttttgtaaagttaacggtataacaaggtatgccaatatttaaacatacggctcttgcgtcatcataatcttcttcagcactacattcaccattttcatcagtttcatcccaatttttcatgaataaaccaattacatcatatccttgtctttttaaaagatatgcacttacggcactgtcaactcccccgctcataccaattacaactttttccacttatacttctccttttataaaactattctattatagtttatacctaattcttttagagctttttcttctcttgtatgacatgtaaacataataatttgtttttcatctgatactgatgccaagtatgacaatacttcttttaacctgtaatcatcatattgaataaagcagtcatccaatataataggcattgtattattaataagtaaattatctatgatactaaaacgaagagcaagatatatttggtcaattgttccataacttaatgtttcagcatcaaccatctgcccgctttcttcatcaagcaccataacgtccatattatcatcaacttttacagtagaatatttaccatttgtgattttagacataatctgtcctaatgtttcgttaattttaggtgcaacatttgtatggatatcttttgaaatactattaattgtatcaatagccttttcaattgcaagaagtttaaattcaaattctttaattcttttttcatatttatttatgtcttcattaattacacataaattttcattgaaagaatttgattcttcaagtattccgtttattctagatagttttgcagatacatttgttatttcatcattgatcacatcaacatcatcatctataatgtttccattattagatttaactaagtttagagtattttcatcaatatcttcaccttcaaattttttagctaaagcatcgatatcatttccgtcaatgatatttaaaagtaatttgttgttactttcatatctatctattagtctgtcatattcttctcttttttctaaagcttctttaaactcttcaacatttgaaatattattttctattaatatttcattcatctttcttcggaaaaatactggtcgctctttagagcgaaaccctaaaactccacgcccagtggcgcccttttatccaaatatttgggcgagcaaatatttggtcgggttttaggggtgaaacccctaataaaaaagacactgcataagcagtgccttttaatttttgagaatatattattcttgttcagctaatgttttgtaaccttgatatctttcaagagcatcttgtttattcttttcgaataattcgtcagctttatcaggatattgtcttgcaaggttagcgtatcttctttcacctttaaggaagtcaatgaagccatccatgttaggttctttgctgtctaatgtgaatggatttttaccttcagcaattagatctggattatatctgtataaatgccagtatccaacttcaacagcttttttagcttcacttccggctttagtcatgttaataccatggttgatacatggagagtaagcgatgattaaagatggaccgttgtgagcttcagcttctttgatagctttgattaattggtttttgtcagcaccgattgaaacttgtgctacatatacataaccatatgttttagccatcatacctaaatctttcttcttagttttcttaccagaagcagcgaattcagcgattgcagcagctggagtagctttagaagattgaccacctgtatttgagtaaacttctgtatcgaatactaatacgttaacgtcttcgtttgatgcaagtacatgatcaagtccgccgtaaccgatatcgtatgaccaaccgtctccaccaagaatccagaatgattttttaactaattgatctttgtttgctaatacatatttagcattttcattgtcacatccgcaagcttctaatgcttcaactaatttagcactggcttctttgctttcttcaccttggtctttaacttctaaccaagctttagcagcatctttaacttcagcttttacagcgtcgtcagcgattaatgcttctaatttatgagcgattgtttttctcattttcttaacaccaagcatcataccaaatccgtattcagcattgtcttcgaataatgagttagcccatgcaggaccttgtcctttttcgtttgttgtgtaaggagttgtaggagctgatgcaccccagattgaagaacaacctgtagcatttgcaacatacattctatctccgtataattgtgtaactaatttagcaaccggtgtttcaacacaacctgcacaagcgcctgagaattcaagtaatggttgttcgaattgagaaccttttactgtgaatttgtttacgttgatgtctttcttagaaagagtcatagcgtaatcccaacatttaccttcttcttcaagaacttctccgataggtaccattttgattgcacctgttggacaagtttcaacacattgaccacaacctaagcagtcataagaagaaacttggattctgtattcataaccttcaactccaggacctttagaagcgattgtatcaaatccttcaggagcgttagctttttcttcttcatttaataagaaaggtctgattgttgcatgtggacatacatatgaacattggttacattggatacatttttcagcttcccatacaggtacgttaacagcagcacctcttttttcgtatttagctgttccagctgggaatgtaccgtcttcataaccgttgaatgcagatacaggaagtgtatcacctttttgagcgttcataacgtcacatactttttcaacgaattcagttctttcaggtttagcaggagcttcgttgtcagctgttttccagctttcaggaacatcaattttaactaattcgctaacaccgttttcgatagcagcgatgttcatgttaacaactttgtcaccttttttaccatatgttttcttaactgagtctttaagtaaagcttcagctttatcgtaaggcataacttcagataatttgaagaatgcagcttgcataatcatgtttgttcttctaccaagaccgatttcttcagcaatctttgtagcattgattgtgtagaactgaatattattgttagcaatagtttgtttcatttcttttggtagatgtttttcaaggtcgtccatatcccaaacagtgtttaataagaatactccgcctggtttaatgtcgcttactaagtcatagttttcagcatatgcttgtgtagaacaagatacgaaatcagcatcagcgattaagtatgttgatttgattggtttttcaccgaatcttaagtgagatactgtaaccccaccagattttttagagtcatatgcgaagtaaccttgagcatacatatctgtgttatcaccgatgattttgattgcagatttgttagcacctacagtaccgtctgaaccaagaccccagaatttacaagaaactgttccttctggaactgtgataatatcttctttaacttctaatgatttgttagtaacgtcatcaacgataccgattgtgaaatcatttttagggttttcagcttttaagttgtcataaactgctttaatgtgagatggtgtagtatctttactaccaagaccataaataccaccaacgattaaaggagcattttctttaccatagaaagcatctttgatgtctaagtaaagtggttgtcctgatgcaccaggttcttttgttctgtctaatacagcaactctcttaactgttttaggtaaaacttcaaacatgtattcaggagcccatggtctgtataaatgaacttttaataaaccaactttttcaccgttagcgtttaagtaatcaactgtttcttcaacagcttcacatacagaacccatagctacgatgatgtcttctgcatcttcagcaccatagtagttgaaaggtttgtaatctcttcctgtgattttgctgatttctttcatgtaatcagctacgatagcaggaactgcatcatagaatttgttagaagcttctcttgcttggaagaagatttcaggtccttcacaagtacctcttgttacaggatgttcaggatttagtgcatgatttttaaattcttgaactgcatcataatcaactaatttagctaattcttcataaggcatttcttcgattttttgaatttcatgacttgttctgaaaccgtcaaagaagtgtacgaaaggaactcttcctttaatagcacttaagtgagcaacacttgcaagatccataacttcttgtacagagttagagcaaagcatagcaaaaccagtttgtcttgtagccataacgtctgtgtgatccccgaaaatgttaagagcgtgagatgctaaacatctagctgatacatggaaaacgcctggaagtaattcaccggcgattttgtacatgttaggaatcataagtagtaaaccttgtgatgctgtgtatgtgcttgttagagcacctgatgctaaagaaccgtgaactgcacctgcagcaccagcttctgattgaagttcaataacatcaacagtttcaccaaataagtttttctttccagcagctgaccattcatcaacgcattcagccattggagaagatggtgtgattgggtaaataccagctacttctgtaaatgcataagagcaataagcagcggcagtattaccgtccattgttttcattgttttagccataatataatatatcctcccaaaaatttatctaaaaattatattatatatattttacatctaacccattataataaataataattaaaaaataaaggataatttaaaaattttttcaaaaattcatcattttttttacaattgaataaatacctgtaaataaggactttttcaacttttcaaagattattacaattatcttgttaaaaatatttcattacaaatgtaatgatatacatcaatgttttatgaatatgttttcataacacttacttactttcataatacttttttaataaaaaacgtccataaaattatgaacgttgtgttttatttaaatatacgtttttctcaaatctatttttatatacttttacatcttatattacatctgtttttctccaaaaatgatatattggatattttttaaaagttttctgttcttcttcagaaagctttgaaaaatatatttcagctgcttcttgttgttccaaaagtaaatatgcccctactataatatcatattttgttgaattatcagcaagtaatttacgtaaacattctttctcatttaaatcaagttctcttatccttttgataaattgtaacttattcaaaattttaatttgcttatcaaactcttgatctggagcttgcgaaatccagtcacaaaattcttgacaagtttttaatattttctctttcctaatcccttctgctatatcataagcttttaataattcaagaaagaaatcacttgctacataatatgttagtctatgatgttctatttttttaaatgcaggaagcaatatattaaaatcgatattatttagtgttaataaatctttataacataaactatgaaattgtgaaacagaaaacatttctccatttatatcttttacaaaaacattcaaattataattaaagaaattatgtattctatatactctatcttttttaagtttctctaaaaaaacaagaaattttaatttaccaatatctatatatcctataatattaatattttctttaaactcaataattccatttttatctaagaaaacctccattaaaattcctactcttttccaatcattatcatataaatcactaatattaataaaaaccttgtaaatactatgataagaaagattacaaaatatacaaacagttcgacaaacagttagaagaatatgttaaagattttaaggaagatgaaagatacgataaatacaaagatataataaaatatatgtttaaagaagaagattttaatgatataaatgatttaattttaccttcgtacataatagatgaaaaagagcataaagttgttattgattttcatccttatagtataagttataattatgaagattttattgatgatgttaaagaacgagaagggagcgaaataaatagtattgatagtaaagaaaaggctattgaatggcttagtttaggattttatcaaaacagaacaatattagggaaaaatgcaattaaaattgactatatagaaaaaacggatgaaaaaggcaatgtttattatgagcttgttattgatgataaaataagagaacagatttataaacaaataattgacaacttggataagacgatgaaagaaaatccttgtgaattttttgaataatagaaaagacaccgaagggtgtctttttttatttaaggagggataaaatgagtaataaaaaagataaatataaaataaattatagcacatatgtatcaggagggagagccatggggaatagtggctcggctattagaggaggattaagctctgcgttttcaagagtaaaatcaacatcaaataaagaaaatacatcttcaaagaaaagttcttccgggggtgtttcgggttcatttaaaagcagtgttggttctacagtgacttcaaataaaagttcaaacagttacgacagttcttctaaaagtaacaataaccttgattataatgtaaagaaatatatggggcagagaggtggaacttttggggataaatcatatacgaaaataggagatgatttttatttaaaggcaaacccatattccggtattgatatgaagaagaacaataagccaacacttttaaaggaaaatcaatataacatttcagaagaaaacagagaaaagataaacaaagggaaaatagaaagttacataaaaggcataaatccttatagcgcaccgccgaaaaacataagagacgcaaaagcgaaggaaagcgtggaaaagctgatgaacggactgcaaaagagaaagagaggacttttaaagaatcaaaatgaaggtgaagttttatcttacaaaaaaggaatagagcaggtcatgaataattacaagccgtacggagcggaccagaggaacgtgaaaaaacaaaacgaaagtttgtattcagtgtatcccgcatacggaagcagggtaacgaaggaagacatatcgccatatggtgcgaagttgaatgaatttgcgaaaaagaaaaatgccaagatgaaagcgattgaggaagagaaaaacaagagtcaaaatcaaagtaaaaaaagtgcggtgcaggaggttatgagtaagtattataaaccgtatggaacagagcaacaaagcgcattgaataaagaaaataatgttttgtttaaggattatccaagttacggaagcaaagtaacgagtcaggatattcaaaacataaatagtgatatgaatagtttggtaaaaagggtgaatgagaatgcaaagataaaagaaaagatagaaaaagagaaacagaaggaaagagaagagcgaagtgaaaaattaacaaacgtaaatgattttgttcaaagtatttacggtaaagacggtacggacaattacggttattcggttaatagtgtagtcggtcaaccgacgaaacaaaactttacaaaagagaatataggaaagtccgtgcctgagtatgaaagttttgagacgaaagaaaaaaaagcaaaggaaatggaaaaagaatgtaatgcagacccaaacaaagaaaaatatataaaaaaaggagaaagtacagcgtcaaacaatacacttgcgggacccaaacatgatacaaatcctttaaaggctcatatagataacagctggtatttaaaaagaggaatagaacaagataccagatataaaaagggatttgattatatcacacaagaagaaaaagatacagccaattatatacttgggaaatacggagcaaaggcacaggcagaatatttaagtaatatattaaacagaatggaagaaagaaaaagagatgaaaaatatagtaatatgaaaaatttaggtccattacagattatgtattacggacttacaaacggtatagaaaataatgcccgagatattgttcagggaatgagtttggcaggaggaaatgaaaatgttattcgtaaatcaggcaaaagtatggcaatagagaaaaagaaaaaagagttaaccggaatggataaacgattatttgatgggactgagtgggttggtaacaatattataagctcacttggttatgctgtaaatcctgctgtaggtggactatttgacttgacaggagaatatggttcaggatatgggaaaagcatggaaggagaatattcaaaaaatgaaaagaacgatatagaagcaggaaaacaaaatgccaagaataaaatgttggtaaagggattaacaaatgtattaacaaaaggagcaggaagtgcttttgatacggtaatgccaaatgacatcaaacatttaaatattatcaaagaaatactttcaaataagttaaatgaaaatgtaaaagataatattgctccaaaatataaagataaagataaagacagagataaaaaataactatatacatagaattaaaaatcatggtataattttaaaaagaggtattaaagttatgaaaaaatctttaaaatattcgcttatttatacaattttattaatattattatttttatttacagttgatattcctaacagatataattcaaatccaatggtagatttaaagaacaaatgttatgattatttaactttaacaggtgaggatgatccttttaaggagtatatttttataatgaaaataatgtatccaaaacctacgtttgggataaagtatgtaaacagaaacgttgattatgaaatacttgaaagagaagaaaaaaaagagattgtagacgaaggtacaatatatgaagaaaaaaattattacaataaagtaaagataaaagtaacatcatataattatgccattgcttataagaatgctgtaaaagcgacgaacaaatataaaaaagaaaatgagaatgcaggtaaagaagaaatagaaacatattttgcagaacgtatagaatatgaaggaaaaaaagttattgacaatgaagaaaaaacagttatgtacgtttataaaaaggaagatgaaattgagtatggggataaaagtcgtttatataaaactgttataagtaaattgccagagcaagaaagtaatttagattttctaaacgcaatgcttggagggttggtcgaagagatggataagacaaagcttccggagggagttgaccttgaggagacgatgaagttaatgaagataaagtagaataggaagacaccgagaggtgtcttttttgttttaagttgatataacctatggtaatgttatataatcattttgaggagaatggtatgaaagaaaaagtaaaaaatattaaaaataaaattggtctttttactacattaattattttatttttttctttaatttgcataaaaaattttatatacaataatgaattaaattatgaaagaagtttggatagtcatggatattatattttatataaagaaaaaaacacatatacagaagaaagagaaataattgaattaatgtgtcctgataaaagctatgatgtaacggttatatttaataagccaacatataaatatataaaagattggcagtttaaatataaaaatccggaatatgaagacgataaaacaggagttgcaagtgaatataattatgatacaaaagtaatgcttgaagtaacatcatatgattattctttagcatataaaaatgcggttacggtaacaaataaatttattgaagaaaatgaaaatgcaagtaaagaagaaatagaaaaatactttgcaaatcgccttgaatatgaatggaaatacataaaaaagaacaaaataaaaaaatcaatttatatttataggatggaatgtcataaaagaagttatagggggggttatgttgttggagtaaaatttttaccatatcagaataacgatgaggatttggcaaatgctgtttttggcggactggtcgaagagatggataagacaaaactgccggagggagttgatcttgaagaaactttggaattaatggggatagaatagattaatagattaagaataaaaagacaccgaggggtgtctttttttgttaaaaaaatatttatttaaggagggataaaatgagtaataaaaaagataaatataaaataaattatagcacatatgtatcaggagggagagctgtaggtaaaagcggttcttataaaaaaggaagtacaggttagaatgggaaaagaagagggttttaacagaaccgttataatacccacttcctatgaaaattctgaagaacttttaaatatattaaaaacaatggaaatgtataattaaaatcaggtattaaacctgatttttttataaaaaataaaaaatatcattgacaattaaatgtatacatgatattatctatataaagttagcagtaactaacattcttatcaaatccttgaatattgatttaatactatataatagctaactatatttttatctttatcggataaaaaaatatttttaaagtacgaatgacgtatttcccaggtaatacttaatgtttaactatccctatatttgtttgtttgttttaaagttaattaagtaacccattttatgaattttatgtcatatactttaaaaaaaagaggttttaaacctctttttttatagtttaatatcttttaaatttacaatacggtttgttacatcgttttttttattgataacaagaaccgtcttgtaatttcattccgcctatgcctttaccttgcccttgaccgccgttaccggctccattaccactaccattgccacgtccactaccgtttccgctgccatttccattaccaagacctaaaccaagattttgagagttgctgccgctgccatcacatgttgcttgattttcttttattttgtttaaaatattttcggcttcttcttttgttaaaataccttgctcaactttttcatttaatattgcttctttttgttctaagttagcctttttaaattgatctaatactccgttttcttttgcaatttctccaaaagtcatatctaaatttattttttgttcaatgattgtttctactgttttatttgttaactttgcaatagcttctgcctttgcatcaaattgatttgacgcaaaaatcggtgttgaaaagccaaaaatagatagagttaataatgttcttgtaattatttttgttctctttttcatttttatatcctccatatcttttctatggatatataatacaaaataaaaatggcaaaattatgtcttttctatttcttttttaagttattgttttataacttaaatataaattctgctccacctttgtctgcattttttgcttctaatattatattatgtctttttgcaatttgatttgctattgcaagcccaagtccgcttcctgtttcatttttcttatcatatgttttatagaatttatcaaatatatgaggcaggtgttcttcgtctattccttctccataatctcttatgattatttgattatttttaaatgttacatcaatacaggaattttctttagaaaattttattgcattgcctaaaataattagaaacatttgtcttaatctttcataatctccgtttatttcatatatgttattttctatctctttatttattgtaatgtttttattatttgcaatttgcattgcgcttcttactacatcatttattacatctgttaaattaagtttgtttacttgtattttaaagtcggtattttgaagtcttgcaaggtccaataaatctcccacaagtctttctaaaaattttgcttcaagaagcatttgtttgtagtattcttgtattttatctttatcagtaattacatttttttgtagtacctctaaggaacctctcattacggttataggagttctaagctcatgagagatatttgctataaaatctttttgcattttatccagttcttcgctttgtttatctgcttcttcaagtctttttgcaagtatatcgagaatttctcccagttctcctatttcatcattttgtttaatattgcatcttgccgtataatcgtggtttgataaatttgatgcaacttctttcatttttgatagaggttttgtaaatagtcgagaaagaataaaagataaaattattacaataataagagatatgataatactgaatgctaaaatggtaagggcctgttttacatctcttggtatttcatctatatttgatgaaataaatacagctcctgttatttcgttttctttttgaattggtactccaaccgttatatttgtttgagaatggttgtcgttacattgttctatacttgtgttttctccgtttagtactttatcaagtatagcctctgcattacttgatagggtagaggtattgtagttatcgcttgaatgtcccatatttttattgattaaattaccgtttgtatctactacccatatgcttgattttgatactttatctataaattttatatatgcaccatatcctcccattcctcttccgtttccgatactttcttcgcctgataatacatcacttaaagcggtagcatattcttccatttgttctttatgcatatttatagcataatttttaaaaaggcataagaatatgcctgctattattattgaaaaaattaaaagggcaatggtaaaattcagtgttaactttattgctattttactttttttcattttcttttacctcaaatttataccctacaccccatatggttgttatgtcccaggaaatatgttcaaatttatctatttttgctcttaacctttttatatgagaatctgctgttctgttgtctccaaaatagtcatatccccatatcatatttaaaagctgttctcttgaaaaaactttgttttgtgctttgcataaagtccaaagtatttctatttctttttttgtaagtggtagtttttcattatttatatatgcactgtatgtgtctatatctatttgtaaattatcaaaggtcaaacattgttttttattttccttgttttccactcttctcattattgctttaatccttgccattacttctccaagtgaaaaaggttttacgatgtaatcatctgctactatttcaagccccattattttttcaaagtcttcacctcttgctgtaatcattattataggaacatttgatgtttttcttattttcctgcaaacagaaaatccgtcttttttaggcatcattacatcaagaagaattatatccggtttttcttcttcaaactttacgagggcatcttctccgtcaagggcgataatatttttataaccttcattttttgcatagtcttcaagaattgatgttatttgtttattgtcatcgactattaataatttattcatattttttctccttatatttatacaatttaattatatatgaaaaatttgtttttttcatggcaaaattaaaagtcttatttattcattatttgtaaaaaaatacacctatgaaaatctttataggtgtatttttatttaaataaattagattttattttttgtaaaattcttttttataattgttaatattaataacatagaaatagatattatcgatacactaatccagctttttatatttgataaatcagaggtgttaggggaggaagtgattttgttattgtcattatttgatataccattatttggtttattattattttcttgattgttttctccttcacctgaattattattgttattatcatcaatatctttctttttaaatattatcgttgcgttaagttctgctccattttctttatatgtatatgttattgtcataccgtctgtgatgttttgaacgatcccgttatttattgtgccgccttttatattagtaatattgtcaggattaatatttgtatccaagtttcgtaaatcgtatgtatcagcggtatttacatcaactgtaacagctctttggttttgtgtatcaatatctttattattagttaaattactatgtaatgatatcattttattgcttgttatgtttacattatctcctgttaaatatggtttatttgacaaatcaatggttataatatctgtcccatagcatagcaattgctttaaatttggattatttgacaaatctaattttttaattggtgttgtagatatccaaacatattctaattgttcgttattagataaatctatttctgtcatttctcctatcaaatacgtaaagttttttaggtttatgttatttgatacgtccaatgtattaaaattatttgctccgcatgttaagtcttctaatttaacgttattttctaaatttaaactgttaagcttattatcaaaacagtcaagtctttttaattctttattattcgatatatttaagtttgtaattttattatgtaggcatagcagggttttaagttttgtattttgcgataaatccagtgatgttatattattatctctacatgaaaatacttctaaattagtaaaaatttctattccgttaacattttctatagacatattatgtatataagataaagatatattcattaatttaaaaaataaaattgaaaatatatatgtaaatgattttatgagcgaattatcaattaaatggagtgatatgatagagaatatgccaaaatatgattctaatcgtatgactttgcagaaagatttttataaaaattatattaagccatttaatgataaaaaagatagaataattgttattgtatctgatgcatttagatatgaatgtgcaaaagaacttaatagcaaattgaaaaactttgcaagtaaatcagatattggatatatgcaaggaattgttccatcatatacaaaattgggaatggcttcattattacctaataaagaagtttcttcaagtttaaaagatagagaattattacttcaaaaagaaaatatagattctattgcagtgaaatatgatgatttatatgaaatgacaaaactagaatggaaaaaactattttctggtaaaaaagtggtatatatttatcacgatacaatagataatgcaggagagcataatgaaaatactatatttactgcctgtgataaagcaataaatgaattagaaaaattagttagagatttgcatacaacatttagtggaataaatgcttttataactgctgatcacggattcttctataaaagaggtaagatagaaagttatgaaaaaacaagtaagatagtaaatgctacaaaacaaaaaacaagatattcatattcagatagtctatctaatgaagaaggtattttatcaataaatttagattatgtgtttggaaaagatagtggctatgtaaatattcctaaaggaaatattatatttgcaagacaaggtagtggcataaattatgttcacggtggaatacttcctcaagaaataataatacctgttattgattttaaatcaacaagaacaacagaacaaagtaaaaaagtcggaattacctacagtgggttatcaacaaaaataacaaatgctattacttatctagaatttttacaagatagtaatgttgatgataataataaaccttgtagatacttattgcattttgaagatgaagatggaaatagaatatctgatgaatgtacaattattgcaaattatgaaaatactgaagttaaagatagattctttagagaaaagtttgtatttaaaaatattacttatgatagaaataaaccttattatttagtaattattgatgaagaaacgggaatagaatctactcgtataaaattctatattgatattgctattgtaaataattttgatttctaggaggtgtaatagtggaagaattaaatgaaaagttaaataaatactttgcaggtaaagttgtaagaaaagatttaacaaagaaaataaaagagggggctaatgttcctgtttatgtacttgaatatttacttggaatgtattgtgcaactaatgatgaaaatgctattgcagatggagtagaaacagtaaaaaagatattagcagataactttgttagaccagatgaagccgaaaaaattaaatcaaaaataaaagaaaaaggaatatacacaatcattgataaggtaacagttaaattaaatgagaaattagatatatatcaggcagagttttctaatttaggaataaaagatgctttaattgatagtggaattgttagtaaatatgaaaaacttttagttggtggtatatggtgtattataaaagtaagttatagttttgatgaccaagataaacatagaatgccttttgtagtagcagggcttgatcctatacaacttccaaatatggacttaaatcaactatttgagggaagaaagcactttacaaaggaagaatggatagatgttttaatccgttcaatgggaatagagccatcacatttaactgaaatacaaaaatggcatttcatagaaagagcagtacctttagtagaaaataattataatttgtgtgaattaggtccaagaggaacaggaaaatcacacatatataaagaaatatctcctaatagcatattagtatctggtggacaaactacagttgccaacttgttctataatatgggacaaaagaaaataggtttagttggtatgtgggattgtgtggcatttgatgaggttgccggaataactttcaaagacaaagatggaattcaaataatgaaagattatatggcttctggctcatttgcgagaggtaaagaagaaaagaatgctaacgcctcaatggtgtttgttggaaatattaatcaaagtgttgaagtattattaaaaacttctcatttgtttgagccttttccaaaagaaatagcgaacgattcagcattttttgatagaatgcattattatttacctggatgggaaatacctaaaatgcgaccagaattaataacagatgaatatggatttattactgattacttatcagaatattttagagaaatgagaaaaaggacattttctgattcttttgataaatactttaaattaggtaataatctaaatcaaagagatgttatcgcagtaagaaagacagtatctggtttagtaaaattattatacccagatgggaaatatagtaaagaagaacttgaagaaatactttcttatgctttagttggaagaagacgtgttaaggaacaattaaagaaaattggtggtatggaattctatgatgtgcatttttcttatattgatttagatactatggaagaaaagtttatttctgtaccagagagtgggggaggaaaacttattccagaaggaatgttaaaagcaggacatacttattttataggtagaggtaattctggaatgataggaacatttaaaatagaagttgaatcaccaagtggacacggaaaatttgcaatatctggtataggaactgatagagaaacaaaagaagcattgaatacagcatttaattatttcaaagcaaataaaaaaagtataagtgcaagtattcaagttgataatgtagattatttattacatatagaagatttacaaggagtaggtgcttcaaaagatatttctcttgcatcttttgttgcaatgtgtagtagtgccttaaaaaagccaatgcagggcagtttagttatactaggaagtatgagcattggtgggacaataagtaaagtggaagaattagcaaatactctccaagtatgttttgattctggagcaaagaaaatattgcttcctatgtcttcagcaagtgatatatcaaatgtaccaagtgatttattttccaaatttaatatatcattttataataacccagaagacgcagtatataaagccttagggatagaataatttttgaagggagttttataatgattaaattaaagaatgttgtaattaataaatacaaaagttttttagaaaagcaagaaatagagattgaagatggggttacaagaatagtagggaaaaatgaaagtggaaaaactgcattacttgaagcaatggcaaaattcaactattttgatccaaaagataaaacatttacttttaatagtacaaacgattatccaagaggcgaattaaaaagatatcaacaagaatatccaaatgaagattttgatgttataacttgtatttttgaattatctgatgatttattaaatcagatttcagaagatgtaggaaaagaagtatttacaagtaaatcaattatagttgcaaaaacatataataatattaaaaggttttataatgtatcaactaatacaaaaaaatttatagaacagttcttacaaaattacacgctagaagacagtataaaacaagaactcataaaaagtaattcactagaagaattagcagaaaaattaaaggaaattgaagaacttacagatgcatataaagagttaaaaacaaaatatatagatagtccaaaaacagacagcgaagataaattagtaagttatattataagtgaatatataattcctaatttacctgaatttttgtattttgatgaatattatagtttacctggtactattaatttacagaaatttttaaatggacaagttgatgatacaatatggctttatccataaaaaacattcctcctatctaattgttaagttattattcttttcaaactccttaataagtttttcttttaattcttctacatatttatcaatgtcttctcttgaattaatttcataagaatgattcattaaactatctgttcttattattgttctcttaacaattttttcttttacaatttctcctgtttcatctgttgcatttttcttactcttttcatattctaatgcattaataaatctatcttttaattggtcaattcttgtttgttgtgcaaatatatcttttaattcgttagatttttctagagctgatataacttttttacaagtttctatatatggtttaccaaacgattcatccacaccataacttttgacttcattttctatatatgaaatagtttcatttatcatttttataattggctctgatttaacatcatacatatttgtaagtatatctattaagtcttttcttaaagtaggtaattcgtgtatttcactatatggctcttttgacttaagtattgaaaccattttttccacaacagttgttaattcttctgctttatcagcatagtctttattattgtcatagatagttattatttttcttgcttcgtcaaattgttctttttgtgttccatcaaagaaatccaataccatttctattttaggtgctaaagcaatgaactcatctttactatctgatacttctttaaagaattctcctatatctcttattcttaatagtctttcaattaatgtaattgcttcatcttttacatcttgtcctggatattgataaacacttccagaaatataataatatcctgcaattttatttaatttgtttagtgtactttgaagacaatcggttttaaagtcctctaccataccatcttcatcttctcttaaattaataacattaaatgcatttcttgctactgattttaaatcgttaattagattcatatcaattttttgtctaatctttataattgttctatcataataatctctttttaatattttagttaaagtatcttctgctgtaatgttttgaacttcattattataaattaaagatattacttcatcttttaacaatcttgttaatatgtataatatgtcttcatctaaaaatccataaggagcagttccaaagtcttgtaataaagttctaattgtcattggcatactaaatgcatttttttcttcacaatattctctcattgcatcataagccttttgattaacaaattctacttcatttccaattagattttgtctattttcgtggaataaatctttaatatcttgtgtattaaaattatgcttaatatacgcaaattttgtatatatgttatttattaaaatctctaatgcttcatttgctcttgcttttgcatctctagaacttatattctgcctatctcctgctataataatttctgcttcatttaattgttctttaatattttctttaactcttgcttctgctttttctatttctctttgttttgctcttattatgtcttcaacttgttgagtttggaaaataccacttttacttcttctatattcttcaacttgtaaataatttgttatttcgtcataaattaaagttgaaatttcaagtttaataaatacatatttattttctcttgcagattgcataataatttctgtatcatctttatctggtgaagtagtaataacttttatacctatttcatattcttgtgaatatttaatgttatctatatattttgtaagtggaaagtttttatttttataagtaaacttattatcagttagtatgtaatcaaaaacaattctctttaaataatctgtaattctattttggtctataactatttgttttatttctctatttatttcttgttcttcatctgttaaaaatttgtactcatcattatttctttgaattaaagtttgagcctctaatcttcttaaagaatcagatatttctttttttattgttattttatcatcttttatgtttgaaacatacaaagttgataagttatctatattagcaggtatttcttttatattttttagcataaataacatttttaaaactttaatatcaatttcttttagagtaccacttttaactgtgtcaatagcattgttaacaactatttttacttgatgttctaaaaattgttcaatagtatcgtaaaatgcataaaatggaataattgttccaacttcatcgctaccatatcttttagcagtttcttgaaatgcacctaataatgatctttcaccactagataaatgttttcctgcatatccgtgttttcttatatcagtaaatacatcttgtaataatttaaattgatatggaatgaatggatatgtttctgcaaaatcattagcaccatcatatactttttgatatgtagcgtttttaaaagttaaaagatttcttataatagattcttctttatcataaatcatttttaaactttcttttgcttcttctgttttatcaaggattctctttttaattacttcgtctatatcagaacttgataaagataatttagtatcaaatctaccttgtatttttgaaaagtcatttccttgaacttttactacatcatctattgcttcttgcgatgtaacaataacccaagcctttccaccacattctagtcctaaatcttctactattgtttgaagatttaacattaatcctctgtcatctccaatatattgacctatctcatcaactaaaaatacaacgtgatgatttagtccttttgatttaatgtaatctctgactctttcagcaaatttttcaactgataatgtataattcttttctgttctttctactacacttcttgcttcttccactgacttatttaatgtttttgcatgagcattagcaaattcatcttctacaaattgaataccatctctcatttcttcccaagaactatttgcttcactttcaaatgcttttttaaattcttcgtattttccttgacttataatatatctttcaatttctgcaacaaatggagttattgaaagtcccattttttcgttaaatactttttcaaaaacatctaatattctgtcttttgttccattactgttttctgttttagaatcaatgttaaaaagaattacatcagtaggaatactccctgctctttttatatcagcaagtagcattttatcatctattttatcatcaaaataatctactgcattttttccattaacaactttattttctaacaaatatgatactatttttaaaaaatgagatttaccactaccaaagaaaccagaaatccaaactcccattttttctgtatttccatttattcctgtattatacgcttcaaaaaaactattaaagtgttttagcaattcctcagttacgacatattcttcaagttcttgactaacataactttcatcatctactttaattactccttgtatttctctttcaatatcctttgcatataactcttttaattttttcatttttactcctcctactttctccctacaaattgaaatgctctataataattatcattttctaatttattaaataatttaaaactttgtccgttgtaacttcctggataaaacattatcaatggattatttgttattacactgtgtaaattatttaatattgtatgtcctcttactataccataacattttcctattcctgttattataataatctgattaggttctacttcactttttattttcttcattatcaaatcgtttccagagcctattcctattgtttttgaaataatagtatttaaatatttagcaccttttttcttctcataatcaaaacatttttctaaaaatcctttttcttttaatatttcaataataatatcgacttaataatttctgtatcttctaattcaagttcatttatgaaatcctcatattcttgtttagaatcataccaaaatattatttttcttgttctttttctttcagtatctctagaaaaagcaccttttaaagtatcttttaataattctaatacttcgtcaaacatattctatcctcctattttattttagcaagtatatctttaaacttatcgtaatttacttttactccatcatctaaatcaatacttattctttgatttgcaatatgtgctattttttcatcatattcttttatttcttgtaatttagcatttaagtctgcttgtcttttttgtgcttcttttttatctgtcatagataattctgatgtaagtttatcatttacatctgttaataatttttcataagttgtctgcattctgtgtaagtagtcaagtcttacttttggtattaagttttcattatatctatgcatataaacaagtgctttaaatccattctttttaccactatcaaataaccagtatattggtcgtttttgatatgtttttacgtggtcattaaagaaatcatttacaaagtatcttctaatagtatcttcacttgtttctgttccttttttacctaatgtttcagcaataaagtctaaattttcatttaacgttttttctccataaacaacgcttataaatgttttaaatctttcaactatatcatcactaaaatacgcttcatcagttataggaataacattatcgttatcaacttcaaatgataaatctatttcttgtccattatcatttaatactttataatttgataaactaacacctgcccaaccaccatcagttttcttgtgttttttgtatatttcatcaaaatctccacctgcatatattaacccttctttatcaagtgagtatcttccaaacatacaaccaactgcataactaattaaagatttcacttctctttctttattagactttttaatagttatatctttatctaatatttcatttgttatgtcattttgtaatccatatatttcaacaaatttattatttaattgaatttcattatattttatttttttaaagcgattatcacattcacttttccaaatattaaatgcttcttttatcgtactaacttttttattaactaatggatgtattttaaaatcccaacttaactcaaaagaatcccaatcttcttttgatatttttatgcactccttgactaattttgtaatatactcattttcttcttctttaaatataataggaagattagcaatatttcctgcttgaacattcattgtaggatttaacatttgtaaaaattgtttcattaattttgaacacatgaatcctaatatatagtacaatttatcttcttttggaaataatgaagaacctgctacatcaaaaataaatccattaggaaaatatctaactcctacatcaatagatataaacgtccaagttataccagatttaaaatacgattttctatttttaataacaaattctgggtctgatatattagggtatttttctcttactagatttataagttcttcaccatcattataataatcaacaataaaatcattgttcccataccattttctatattttccacctttattatacgggaaccatctttttccactatttttggcttcttcactatttttagaataaaattttatattattaatatcaacttcaaaccagttcctcataaatcttttgttatcagttgttgccattccttgtctaggaatagcatattcttttaataaaattgctttatcaaacacttttttataaccatcacttatccaatatgcaaatggtctatcatttattttttcaaaatctctcattttaaatttatatttataatctacatttgttttagtaagcgcttctatagtttttataggttgattttcaggtccagggaaattggataattttatataatatccttctaaattatcagtagtattttttaagacatatgtacatacaggtaacgctgccacttcaaatgcattaaactctaactgtattaaactgctgattggtaaattatatattaaatattgtcttaaatccttgtacgaatccaaaaacatccaagcataaggtgtaatcatacctatataagattccttttttgataaccattgacaaactaatataaaacttgtaaacatatctgcttttgcaatagaataattagtcctaatatatttttttaaagatggcgaaaaatatttttctcccatataaggtggatttgttactacaatatcatatttatcactcataatatttgcctgctttattaacggttcgatttcacttttcaatatatttgtaaccaaatttatttcagaatttatataatttaacaaatccgtataatcatctttttctatttttaataaagagccatattcttttgcattaatataacaatttaataatttaattaccttttgttttgcgtttaatggaatctcatcaattatgaaatcactaattttttttgattcttggatactaattatatttaaattttgtactatatctttgttaaatatttctttatcatattctcttgcctttaatataacagacaatatagataattgtcctgctctatcatctatatctaatccaaatagattattttttaatattagttcaggaatatcttttttattaaatcctgattttaaatacatttgataaaatacttcaaaagcatatacaagtatatgaccgcttccacaacaagggtcaataaatgttatttctattggatttaacttatcttttttattttctatattatctttaataaaatattgccaattacttgttatagaagatgaaggatataagttattacttggatataaattgtctgatggatataaagccccatctccattgtgttctacccaataccttcctaatgaattctcaaccatatattttacaatccagtctggagtaaataactgagtagcataaggaatttcatttttcttatatgatttctttgcagaaataactctatctttttcagtttgattataatactgatataaccaccctataatctctacttgattataatttttttcaggtacttcatttattacttttgtaataaatcctgtatcatttaataaattgtctggtattaaaatatcaatataatcagtaattccatcaaatacttgtggtattactctacccagttttttgcatactaacaataatacatatttaaacttttcattgtcatcttttaactctacatatttttctttttttaaatttatatccaaatacggattcattaaattagtgaactttaatatttctggatctggtgttttatttagaagtagaaagaaggttttaaaaagaagtgtaaatatttatgggctgactttgtctattatatttcttttaattgaagggatgatgcttagaaatttaaatttacaaaggcattccagtatgtatatttttcttgttcctttagttgtttttttattctcttttattttgagttttaatatagagaataaaaaaacattaagaagtttgtctatgtatgtttatataattcatccttttataattgttttatgcaggttcatattaaaaaatattgtatcattaaatattgtaataaataactcgatgttattttatatattggtttgcattttttcttatttgttttctgaaagtgttaggaaattattttcttatagagggctaataaatggaaaattataaaagagcttggatggaaataaatcgaaataatttaatttataatgtaaaccaatttagaaaattactgggaagtagttgtaaattgatgcctgcaataaaagccaatgcatatggtcatggagatgttgaagttgcaagtattttaaatgaagcgggtgtatatgatttttgtgtagcgagtttggatgaaggtataagactccgtaaaagtggtatagtcgggaatatattgattcttgggtatacagatgtaagttttgcatatcttattaaattatatgatttaactcagactgttattaattatgagtacgctttaatgcttaataacagtaaaatagatattagggttcatattgcagtggatacaggtatgcataggcttggagagagtttttcttctgttaatagtattttagatatactacgtttaaaacatttaattgttgaaggtgtgtttagtcatttatgtgtaagtgatagttttagtaagaatgatattatgtttacaaaacttcagataaagagatttgaaaaagttagaaaaaatttaataaaaagaggatataaggatttaaaatatcatattcaaggaagttatggagttttgaattacccaaatttaaaatatgattatgtaagaataggtattgctctttatggtatttacagcaaaagtaaagataaagttttgtgtgatattaatcttaaatgtgttatgacgttgaagtccagaatagagcttgttagagatattggtgttagtgaaagacttgggtatggacttgattttaaagcagataaaaaaatgaaaatagcagttatttgtatagggtatgcagatggtattccaagaaacctttcaaataaagggtatgttttgatatgtggcagaaaagcaaaaatagttgggcgaatttgtatggatcagctttttgttgatgtaagtaatataaatgaggttaagattggagatgaggttgttttaataggtgaaaatctaagtgcaatggatatggcagatgtgggaggtacaatttcaaatgaaattgtaagtcgtttgtcgaaaagagtatcaagagtgattatataatgtattttatatgtttaatttttaatttatttctaaatttcgttttatatgtataaaaaacaaagtattagtgctataatgttatgaaaatgaaaaaataaattaaagaggtaatattgtaatgagtgaatgttcacatgattgttcaaattgcagtgcaaattgttcatctagaaaacaaacaaaagaggattttcttgtaaaacctcataaaaaaagcaatataaaaaaggtaattggagttgtaagcggtaaaggcggtgtcggtaagtctttagttacatctttacttgcatcaaacatgaaaaaggctggatacaatgtagggatacttgatgctgatattacaggaccttcaattcctaaaatatttggtgtaagcggtagcgtttatgcaacaaaagaaggtgcatatcctaagaagagcgaaggcggagttgatattatgtcaataaatcttcttttggaagatgatacaaaacctgttgtttggagaggacctgttattgcaggagctgttggtcaattttggactgatataatttgggaagatgttgactatatgtttgttgatatgcctcccggaacaggtgatgttcctttaactgtttttcaaacaattcctgttgatggaattgtgattgttacatctcctcaagagcttgtttctatgattgttgaaaaagctgttaatatggccgaaatgatgaatatcaatgttcttggacttgttgaaaatatgagttacattgaatgtccaaattgccatgaaaaaataagtgtatttggcgaaagtcatgtagatgaagttgctaaaaaatatggattagaagttcttgcaaatattccaattgatcctgaaattgctaagaagtgcgatgaaggtaaaattgaacagcttgataaacaatatgttgataaagcaattgaaaaattaaaaaatctgtaaagggtgtataaaatgataaaacatatagtttgctttaagttaaaagataatagtgaaaaggcatgtagaatggctaaagaaactcttatgtctatgaaagatcatgtatcattaataaaagatataaatgtaggaatagactttctccattctgaaagatcttatgatttaatattagaggttgtattggattcaaaagaagctttagatgaatatcaaaaagatccatatcattgtgatgttgtaaaaagctatatgcacaaggtgagagaaactagtgtggcagtagattatgtcattgaatagattttttgtaaaaaaaactgcaaaaaactgtaaaaaaggtattgacatagtgtagataaagtgataatataacaaagctgtttcaagcggatagctggataagcatacgagaagaagtcaatgaaaaaaaatgacaaaaaaatgtttaaattacaatctccttcaaattttattgaggttaccaaggaaaatattgaggcaggagaaaatatatcggtaaatgattttgtagaaataaaagataaatataaagataattattctataaagccaaaacaagataagtataattttaaaacacttggagaaatttcaattccatatatagttacagataataatggagaagaaaaagaagttgattgtacgtttaatgtagttgatacaactgctcccgaaattaatacaagcaaagatttaacaataaaaaagggatcagattttgatatatcaaaatttgtttctataaaggataatcttgatggggatattgatataaagaatttgaatatagaaaacggaaatgtaaatacaaaagaagaaggtgaatatacattaactttatcggtaacagatagtaatggaaataaaaataaaaaagaagtaacttttattgttaaagaagaaataagtgttgatgatgtaatgcagactttactcggattatggcttccaacagaatatgcgagtatgtatagtgaaacaggtgttacaggtgatgcaatgatactgtatgtaaaagagggttcaaagtattatcaaaaaggttatgaaagttctgctaaaataacaataaaaagtatacaggaaggcggaaggattatagaatatgaccttgcaggttttgaaggtataaatagttattcatctcatgtaacgattgatatggggcttacaggggataatatgattaatattaacggtgtaagttatacatgggttggtagtggatattaaaattgaagggaaaattttaaaatgaaatattgcaatagatgtggaaatgaaattgttaataatatcagcatatgtcctaattgtgggaatatattaattcctgaaagtaaactaaaaaaagatgagtttaatctagcttatttttctgccggaagtgtcttaggtggacttttagggttgattggtttaggaatatcaattcttattcttattctaaaaagaaaagagcctaaaaggtatagttctgtagtatacggagcactgttaggatgtatagtagtatcgatttgtatgatgatatttaatttatagaaaattaataggagaaattatgagtttttgtaaaaattgtggaaatgaattaaatgaaaatggaaacttttgtacaaagtgtggtatgaaagttgagaaagcagtaagtataccaaaaaattactgcacaaattgcggagctgaaataaaagaatattctgatatttgtttaaattgcggaatgttgatttcaaaacaagaaagcgtaaatgatgaaaaaaattataatgtactttcgatatgtgggtttgttgtttctattataagtctattttttggattgttaggtttaatattagaaatattggcaatgataatgggagttatttctttaaatcagttgaaaaataatgataaagaaaaaggacaagtattttcaattctatcaatcgtcattgcgtgttcatatattattttttatttattaattatggcaactatagtttcatatttttaataacgaggttaaattaatatgattgtgatttgtgataaatgcggtaaagaattgaaaggcagtaatatcaaatactgttcttgttgtggaaacaaaataagtaaacttaataaagataattatagagaaaagtataatactactttgtcaaaaagtagaaaaataatgtgtcctatatgttgtaaattggtgaatcctattgttaaggaaggttggtattattgttctttatgcagtcgtaaaattcaaaaagaagcatttgaatttgataaagaaagtattcaatgcagaaaaaataagaaaatagaagagatgaaaaaagaaatagaagaaaaaaagaagagtgatgaattttattatatatgtgataagtgcaatcgtgttattaagtattcatctaaattttgcaaatactgtggtgagataaataaacaaaagaattttaatagtgatgaaaactttacttctataaaaatacaattaacatctacaaataaatatatagccggcagtccaaatgatcttatcggaacaccgagaacaatttatttggatggtgaagaaattggtaagatgggagcagaagatgtaaaaatatttgttactaaacttaaaggtaaacatatcttaacaatatatagaaattcagatatttttaattgttcacaaatagatataccattagttattgaatcatgtaaggaatttaatataaaagttgtatttggatataagattacatacgaatttttaaactaaggaatgaaaggggaattagatatgtattgtactcattgtggaagtagaatatgatgatgctaaaaaaatcttcgattttttaagcggtgctgtttatttttgtcattttttttcattgacttcttctcgtatgcttatccagctatccgctcgaaacagctttgttatattatcactttattccttatctgtcaataccttttttacatttttttgcagtttttttactttttttataaaaaataaaaaaaggctgtaaaaacagcccttagagtatttcaattactttacagattcaccttctattatactatgtgatactattatttttttctctttcaaatcctcaccttcaagcaatttaacaagaagtcttgcacttattgcccctacatcatacatatagtgatttatgcttgtaagagttgggttaatccaccttcctacttcgcaagaatttaaacttgcaatacttacatcatcaggtactttctttcctgattcttcaatagcttttattgcaccaagagccatttcatcattaccacatataactacatcaggaagagttccttttaacatttcctgcatagctaaatatccacctttcatcgtaaaggcattttcataaatcttgtttttttctattttcattccaagcatttttgatgttgaaaaaataacttcttcattctttttagcattataatctctatttttatcgccatgtattaatccaagagtattatgtccttttcctttaatatattccattagtgcatatataccttgattataatcattgatgacacttgaatattttcccgcagggtcttcaacaccacataatattacaggcatattcatatattcaaattttcttttaacaacatcatccagttccctacccgcaaaaataattccatcacattgtttttgataaaacaaatccataaattcttcttcttttttgctatctgcatcgctattgcaaattatggcattatacccgctttgcatacttatatcttgtacacctctggccatttgagcataataaggtattgtaatatcatgtataacaacaccaacagtttcagttttttgcaattttaaacttctagctatggcatttggtctgtatcctgtttcttttattgcttgtaaaaccctgtcttttgtttcttcatttaccaaaggtacattatttattacacgcgatacggtagctatagaaacgtttgctttctttgcaacatctttaatttttgcgctcaatgtagcacctccatattattacatctgtcattataaacttcattgccatgtaaaagtttaaattattctaccacatcatgtaattattttcaattagttatgattttttaataaaaataattaaaaaaaactacatataaatataaagttgattgaaaatattgaaaatttttatataattttatataagaaattaaaaaaaagagagaaaatatgaaaaatagcaatttaaagtttaaacatgttgaaaattatttcatgtgtccaatatgtaaaaatgaaatgcatattgaaaataacacattaaaatgtcaaaataatcactgttttgatattgcaaaaaaaggatatattaattttttatcaaatagaaagcctcaaaagggttatgacaagagtttctttgaaaataggaacattatattaaaccaaggatactatgaccacatatgcgattatatccaatcttatataaacacttttaaacctgacacagttattgatgccggatgcggagaaggtttctatgtcaaaaaattatataatgaaaacatagatttttttgcttttgatttatctaaagatgctattaatgttgcagcaagaggcatgaataatatttgtttttttgtttcagacatacaatctattccactaaaagataattctattgactgtatgttaaatatatacacaccggcaaattatcccgaatttaaaagagtattaaagaaagatggtattataataaaaataattccgggtctttctcatttaaaagaattaagacatattgttaaagactcattaaaacatgaacaatacgataataaagaagtaattgattgttttaaagaacattgtacattattggatatgaaagaacttaatcaaacaaaaacaatttccatagataatttaaaatctttcttagatatgacaccgttattgtttgatattgataaaagtaaatttgattataataatgtaaatgaaataactatttccgctaccgcattaattggaaaaataagataagaagaaattgaaaattttttataaaaaaagaacatctttattgatgttcttttttatttatcatttactaaaattattatattatctattaaaaataaatacagatttttttatttttaaaataataaaaaagcaaaccttttgatattcctgccttataagtaatttcttctgtaacgacatttttataatcattttttgcaaatacttcaatagcagcatttattattttatcttgtttttctttttcaagctcataaaatttttcattaatcatttattacttctaatacatatctaataaaagtatatattattgactatttttgtaaagccttgagatatcttttttataatatttttttatgctataatgctaacaggaggatatatgaaacaaaaagaaattacaattagaaatctaaaggatgaagatttacctcagataaaaaacttactttacgatacatggataaaaaaagactatggagaaaatgaaagagtggcaaatgaaattagttcaatttttatgtatgaacttctttatcgccaatcattttcaaacgttgcagtctataaagagaaagtcgtaggaataattcttggaagaataaataaacattataaattaaaaaacaacatcatatacataataaaattaatactacactgtttaaaaactatacttcttaaagatggcataaaagctttaaaatcagaaaaagaaacagcaaaagtaaacaatgaacttttaaatagtttaagtacagacacagatggagaacttattctttttgctttaaacaggaacataaaaggaagaggtttaggttctaaattattaaattctttttataattatatgaaagaaaataatgcagataaattttatctttttactgacacaacatgtgattatggtttttatgaacataatggattcaaaagagaaagttcaaaaaatatttatttcaaaaaagaacctcaaacatattttatatacacaaaaaaattaacttaaaaaaggacttttaaaaagtcctttttatatttcaaaagaaataaatcctttctctttattagaaaaagtatataatttttttacgccggcagcttttaatctgcttattccaagattataaagaagatcaagcatttccaaattatgagtatcagatgacatagtaaatttaattcctttatcatttgccattttgataatttcatttgatggatacaaacttcttaccccatgtttatatccccctccggtatttaattctaaaacagcatcaatttcttttattttatcaagaacatctgacactaaatctttataccatttactttcttcatcaaagaatattccgtctatattattcttctttattaaatcaatatgccctgcaacttcaggttttaattcacataaattgttataataattctcataataatccattacaaattttcttgcatcattatcgtaacttctctttaatgattttctaaaagtagaacataactcatcaacaggttccataatcccgtttgcattggttaaatgaacagaacctacaacataatctagtctatctctaataccagaaatatcactcattaaatatccgcttttaccatatctttcactttcgattccggcaaatatttcgattttatctttatatttttctttatattcattgattttatcaacatattcattgtatttttcaggttttaaagaatgattttcataattataagtacaaacatggtcggtaataccaaaatgagtaaaacccctgtttattgcttcaataattaatgtttccatttcatctttaccgtcacttaaattcgtatgattatgaagtgatactttatacatcttttataccccctatctattagatatcttttctaccaatataattccggcatctttttcacttatctctcctatttttattttataatccaagtctaaacataagtcaagaaaaacatggatttcattcaaagaatatttctttgaagaaatgtttgccattttaactgcatatggatggagagaataatcttttactatatcattttccgttttacctttttttatatactgtttacatatatacatattttcaaaatttcttacaacaacaccaagtatctgcataaattttacatcattatattttaaattatgcaaaagtttaaaagcataatctgaatttttatctcttagtgcatcagtcaatttgaaaatttcatcttgtatatttacacttataattttttttatttcatcaatatctattttttctttatttatacttgataatttttttatttcaccttcaaaatgaatctaaggaggaagtatggataaatttgaattaattgtactttgtgctttattatcaatatttttaattgtaatattatatttcgtttttagaatgttatttacaaaaataaaaatgtttttttataatttaaaattaaaaaaatttaatttacttttaaataaaatttctaaagacttgaaagtaggtcaatatccaaaagttgaagatattgacgaattaaaaaatattcttcaaaaagacaataggattaaagaaaaatattattttgctgtaaaagaacttattgaagaaaatataaacgataaaattttacaaaaatttatagaggaaataaattcttgtatagtaacaagtgaagacatttcttttgaatattcttattcaaaagatttggaagtatttattgtgaaaactaattctttttggagagaaaataaaaaagtggatgagtttctactaaaatgccttcattcttcttcaaagaaaatcagacttcaagcaatgaatgcaatagccaataggggaaatattgcaagttttacaaaagcattcgttgttgcttgtgaaagactttctgattttactcaaatggaaatatatgatgctttggataaatttaaggataaaaaaatgttacgcagtgtacttgttaaattaagagaagaaagtgaaaatatcagacttaagtatattgtaaaagaatatttggcataacgggagtaattatgagtatattatatgttatttttattatttttattgtttatacgataatgtatggaattgtttcgttatttagtgctgttattccgtctattatggtatttaacaatttaatgaaaaataagaaacgatatttagatgttgaaaaagaaggtaaaaaaataacattagtattaaatgaagaaaaaaatattaatgaatttattttaaagataaatgatttaacaaaacttgattatgaaaattatgatatttttatcattgtttcaagtaataatacttttttatcaaagagaattatatcaacatttaaacttcaaaaagaaaataaatcctttatatacaatataaataaagaagagataatatctatttactctaatggaaaaattaatcttttaattaaggaacaaggcagtaaatggaataatataaatgctgttatagataatatagacagtgatttatttatggttttagaagaaaatattgatatagaaagaacctctttaagtaaacttgcaagggaatttatgctttttgacgataatctattttctatgggaataataaaaagcagagtttatatatctgaagaaaatctaagtttcaaagaaataaaaacacataactttttacttggaagtgttattataaagagcataaagaataaattatttctaaagacttttaatgaagaattttgcagtggttttgaaagcggtaataactttactttatataataaaaacaaagttaaagatgttggaggattttctgataattgtataaatccaaataacgacttaaagaatcgtttgactaagaagtttggtgatagatataatatagactatgaagctcttgcatttaaacaagaagaagattttaagccttatttatttaatgaaatgtattcaacttatattaatgcaaaaaatcaaaatgcaataaactcatttatggggcttagtaaattttatgaatttttatcgtcggttttaaatcctattttggaacttccgataataatattctctcttgttttggcgtttttaaaggttataagcataaaagaatttttattatttatccttttatatatagcttttgatatattaaaaaatatacttcttgttattacagataaaatatcaataggcaagaattataattttgttgaaacattagaacttattggtttttgtattgtttatgattttggtttaagacaatactatgatttacataagctttcagtaagatttatacttttcatctttttacactttctttttttgatgtacttttgcatcttttcttttcattattcttttttgtgtagtttcgattctctctttttcaaattcttttctaactattatgttagcttttttaaataacttaaatgcaatttatatatctttcaatatattttcttgcttccattttgttttggatttgttaacgttttctatggttatattatatgcataatatatataaaattcaatactttataaaattttggtaaaaaaaaatttattgaaatcttttttttataaaatatatacgttttcatttttttttataactaaaagattacttttataagtatttttttatcaatataaaaaaagaagaagttaaacttcttctaataatgaactactataggataatttgcctgtattgtttcatatgttttttttgcatttttcttaggcatatttatacagccgtgacttccgttatttttatatattgttcctccgaacttacttctccatgttgcatcatgcattccaatccctccgttaaaaggcatccaataggaaacaggtgaattatatgtacttccatcagcattacttccacttaaagtagtatctctttgtttatattttaagtaatatattcctgcaggtgttgagtatccaccagcttcatctcctgttacaatatctgatgtaacaatttttttaccatctttataaacccaaagtttttgatttgttaaatctatttcaacatatgaatcgcctacttcatcggatgtatcataagggatttgtgaatagcaaggttttctgtttatattttttttcttatttaattctgatgttaactttgttatttctttatctttatttatgacatacccgtaatcgccaccggttatagatatagtaccacttaaagttgatttaaattctctcattcttccgcttgtattgtattttgcggctaagtcatttacaaaactttttactgcacttttatctactcttaatttattttctttcatttttgtttcaattgttttatttgttattccatataactttagcacttgttcttgctctatttttacatctttatttgccattttatatgtgatagaaggcaaatctaaatttttcaaatattcttgttcttgttttaaaattgtgcttgttgatataatttcaggtttatcataataatttttttcgttatagctaagagtaaattctccctttgcaacgaactttaatatatctttttttaacaaataggaatcaatattcgttccatatacttctttaattatttcatactcttcgctatttaaatttatataagcattttttgttttagttgtatcttcaccatcttctaatactgataatttttttaacgattcattaaattcatcgcttgtttccttaatagtcatagaaattgtatatttgttatcttttaaatgtgtcttatgcatgacatatgaaaaatatccaggatttacaatatcgtttaattgttcatcaatattatatgtaacatttgataaagatatagtttcggttttttttaatagataatataataaaaataattgaaaatagaatatcaaaagataaaataactcaaataaaagattcttttgatttaatgaattatgccgtaaaaataaagttagatttagtaaaagaaaatccatatatacttgatttttgcattagaagttattattgcagtgataaaaatatcatcagtgaaataaaaaaacttatagtagaacaatttaatgaatcatatgagaaatatttttataatatagatgtatcaaaatttaaagataaaaatgatttgtttatgatatataaaatttttatttggattatggatggatatttgcatgaaaaattaatgagggatgaagaaattaaatcttctgatatcattttagaatttgatgaaattatggaattattaaaaaagtatttttataaataaatttaattatggagagtgaaatgaatattatcgaagtaaataacattactaaagattatggagacaataaaggcgtttttgatttaagttttaacgttcaaaaaggtgaaataatgggatttttaggcccaaacggagcaggaaaaacgacaacgataagaacattacttggatttattaaaccggataaaggtagtgtagaagttaatgggttggatcctttttttaatagtaaaataattaataccaatttaggatatttacccggagaaaatactttaatggatgatatgaaaggcgatgagtttattaattttattgcaaaaatgaaaggtgtagaagattttgtaagaattaatcagcttaaggaaatgtttgaattaaatgcttcagggcgtattaaaaaaatgtcaaaaggtatgaaacaaaaaattgcaattatatgtgcctttatgaattatcctgatattttaattttagatgaacctacaagcggattagatccattaatgcaaaataagtttatcgatttaattttagaagaaaaaaaacgaggagctacaattttaatgtcttcccatatatttgaagaaattgaaaaaacctgtgatagaagcgttatcataaaagaaggaagacttgtattaaatgaaaaaataagttctttaactaaacaaaaaagcaaacattttattattaaatttgcagatgaaaaagaagctatgagatttactgcattatttaagaatattcaccctaaaggagatactgttaaaattaacgtaaaacaaaatttagataaactaataaaattattatctaagtttaacgtcgttgatatggatataaaacctttaagtcttgaagaactatttatgcattattatgaaggagaaaaaaatgattaatttagtacttttaaagaaagaaataaaatctaattataaaatattatttatatttatggctattttgactctatattcttcgatgatagtaagtatgtttgatccaaaacttggggaaagtttaaaaatgatgtcagaaagtatgtcaggtattttttctgcttttaatatgtctaatacgggtactagagtacttgtctggagacggactgggagggtaggtagtcgcggggtttttttattatttataatattatatttaattttagaactaatacaaaatgagaaatattatttttttatttgtattagctttaaagttttaaaatttgaatttttttattgtatatgctaaaatatataaaatataagactaagatttataggagatttacatgataaatttagatagtttagaaattaaatcaaatgcagataaagtttttaatgtaataaaacaactagagttagatattttagaagaaatagataaaatatgtagaaaaaataaaattgaatattctattggaggaggcactatgttaggcgctattagacatggaggctttattccttgggatgatgatattgatatagaattaacagctgaaaattatgaaaaacttattgaagcttgtaaaaaagatttaaatactaaaaaatatacattattaacaaatgaaacaaatccaaaatttaatgattttccggcaaagattttgttaaaaaatactattgctagaagtaaatctgcaagaaacgcgaatttaccattaactttatgtgttgatatttttaagttagataatatgcctaatgattttgaaaagagaaaagaaattgcacataaattatttaacttacgacaatgtatgttttgtaagacatataataatattacatttttaaaagacccaaatgataggcaaggtaaaaatttaaaatatataaaatatgtgtctcgtccagctttatataaaaaaataaaaaagctcgaaaaacaatgcaatgaattgtataaggattcagattatttatatgataattgtatctatcatgtaggatattatggagaaccaaattttgataaaacggggtatgaggatgttaaatttgaaaatttaactgttaggaaatttaaacagcatcacgaatatctatgtaatttatttggtgatgattatatggaaatgcctccagttgaaagtagaatgacccatcataattatgtagaatttgatttagggccatatgcaaagatgtatgatttacctgatgattatgaaaaatatatgattaattctttggatggggatagattatctagaatgaaaaatttatgccttgatatgttggatgaagttgatagaatatgtaaaaaatatgatataaaatattttttaagtggtgatgatttaatatttaaagctaaaaatattgaggaaatgtctaatttatggcgtaaagatgtaggaatattaatggattttaataatttaaagaagtttaatagtgtagttgaaaatgaacttgatgaaaagtatttctatcaaacagaagaaacagattctgaatatttctatgcttatcctaaaataaggcttaaagatacttatttaaaagataaaagattagtccctgctaaaataaatgaaggattatggattaatattggtatatagaaacattttcaaaatacagttttgaagaattaggattataaaatataaaatcagctaaaaacatcaaacgaaagtttggtgtttttttattacgaattttgaaagggggtggttaagttgaaaggttaaaggtttaggtgattatatgttaaaaaatagagtcgtctataaagattctatttggtatggcttcttgaagtttctttaaaatattagctttattatatgcatatgtgttaaacattctaaaatcttcaaaattttttgctgcgataataatttttatattgtcagaatttgaatttttgtaataaatattcatatatattttatcaataaattcaaaattatcattgatattaaattgatgttgatggaatgtagtgacattataacaaattttatttatatcatcatatggtataaagactttttttgaaaatggtgtttcagatttaaaggttaagcctttatcatttgcagcaaaaaatatacaatcaaaatctacatatgccggttcaagaccttcataatactcaatatttaatatgtgttttgattttagtttgcgtgttatgaaaaaataagttaaaaatctgaaatgggaaaacctccatttagtgatggaacatataatgattattattaaaatgcatactaaaataattttaaagccaaatacagaaacacttatacgttgcatgttaatcacctctaataatttttttaaattatatcataataaaacatagaaaaggagataaaaaataaaaagctttgtttattattgatataaggtttgaaaatataggtgtaaattttatacaatttttaaaagaataagaaatttaataaatattataaatcataaatataacaattttctacatatattttgaataaaataagtaatatcaaatcttacaaaaatgttattgaataaagaaaataaaatgataaaattaaattatataaaagaacgaaatttaaggagggaattatgggtaacgataaaaatgaaaaaaagattaaaaagcaaaaagattggattttgcattatttgaaagaagtagacagtattttggctcaattagatgaagatttacctgagaagaaaaagaaaaagctacataagaatttaaaggatgcaaaatggtcaatatcatacaaaataaaagatgttataaatatgggtggtaatgtggatgatattatgtgtaatatatctgcaaaacaaatggaatatgtaaaagaactttttcctgatggtgcaaacgaagaagtaataaaagcgagaaaaataatagataatataatacttagaatggataaggtaaagaagctgaaacagaaaatgacatttgatccaaatgatgatatagaaataaaagtaaaaaatgatttatttagagcctatgaatttataggaacatatataatggcgttggaagataaaagtctaagaagttattctcaattgtatcgacttggtatttattataattggaactatgtagttcttttaaaaatcttgctaaatcttgtgctaatttatctttttcttcatcagttaatctttcatatatttctttacttaaagaaacaccattaatttttgtaaaacaagcaatacaatatttataatttgaattatcattattaacatataaaactttaggtatattaaaagttgttttattttctaaatattgtagtatttcaatttcttttaataaattttcatttgctttttcgtgtctaggaaatttaaaaatcatattatcattaacttcataagcaaacgagtcattaccattaccaattaatttaatagaggttattttgatatcaaaactatgttcaattatatattttattgctttaacattagtttcattatcatcatatcgatattccattaaataacaatcttcttttttaccttcgtgaagttcgtgttctggtaaatcttcaataattctaaatcctgctttttgatacattctaattgctcttggattatcttggtgtgggtccaatattacagcatctgcatttctttctttttttaagaattcaaaaatcatttttgtatattttgttcctatgcctttgctccaataatcaacttcaccaataaattggtccataccataaacaatatcattacttctagggtaatgataatcatcatatagttcatcatacattttatatatttgtccataaccaataggttgaccattatattcaataattactcttataacttcatcttcccaaggttctgtataatgttcttttaaagtttctaatgtatattttttatctctaccaccataaaattctaatactctttcatcggtaagccattttaacattaatggaaaatcattatcatttaaagttctaacccttatattctcatttttaatatctatcatttttcatcaccttcaaaatcatatacatagcaaatttcatcttcaaaatcatttttgccacctaatttttcatatacatgacacgctctaggatttcctttatcagtaagaacaaacatttcaaagaatccattagaactaatataatctttaataaatcctaataatttagttccataacctttatcttgatagtctggtaacattccaatagaataaataaaatatgcatgttttccatttggatgaataatatcatatccataagcaaatcctacaattttattttcagctttagcaataaacccaataacatttttatcattataaaattcatttattttttctaaatcaaattctatatcatcatcttcgatgatttctttcattaattctaaatcttctttttctaataatttatattccacaatataaaaatggcaagagaaaaatacgaaagaactaaaccacatgtaaatattggtacaatcggtcacgtagaccacggaaaaacaacattaacagcagcaatcacaaaagtactacatgaaagattaggaacaggtgatgcagtagcattcgaaaacatcgataaagcaccagaagaaagagaaagaggtatcacaatctcaacagctcacgtagaatatgaaacagaaaaaagacactacgcacacgtagactgcccaggacatgctgactacgttaaaaacatgatcacaggagcagcacaaatggacggagcaatcttagtagtaagtgcagcagatggtccaatgccacaaacaagagaacacatcttacttgcaagacaagtaaacgtaccatacatcgtagtattcttaaacaaagcagatatggtagatgatgaagaattaatcgaattagtagaaatggaagtaagagaacttctagacgaatatgaattcgatggagacggaacaccaatcgtaatcggatcagcattaaaagcattagaagatccatcaagcgaatggggagataaaatcttagaactaatggaagaagtagacaactacattccagaaccagtaagagatacagacaaaccattcctaatgccagtagaagacgtattctcaatcacaggtagaggtacagtagcaacaggtagagtagaaagaggtatcgtaaaagttggagacgaagttgaaatcgtaggtatcaaaaaagaaatcaacaagtcagtagtaacaggtgtagaaatgttcagaaaacaacttgacgaaggtgttgcaggagataacatcggagcattactaagaggtgtagacagaacagaaatcgaaagaggacaagtattagcaaaaccaggttcaattcacccacatacaaaattcaaagcagaagtatacgtattaacaaaagatgaaggtggtagacatacaccattctttaacggatacagaccacaattctacttcagaacaacagacgtaacaggagtagtagaattagaaggcggagcagaaatggtaatgcctggagataacattacaacaacaatcgaactaatcacaccaatcgctatcgaagaaggattaagattcgctatcagagaaggtggtagaacagtaggttcaggagttgttgctgaaatcgttgaataattttagtaaatgataaataaaaaagaacatcaataaagatgttctttttttataatccatctgtttgatacataactaaacccattcattatatatccgaacaatgggaacattaaagctactaataaaataattaagatatttcgtaaatataaaccttttttacttttatctttaaaaataagtaacaaacataatacagttaatatattaaaaccaatatatgtccaagaacctacaacattaacattaaacatattctgaataaaatttatataatatgttatatcataaaatatatttaatgaacttaattgtccacttgctcttgaactgttaaaaaaggcaattagaataggagaaaacagtattgaacttaaaagaattgcaataatataataaatgacaaatttcaaaagataataccaaaaatttttccaaaacaatcctctatctttatataaataaagaaccctaacaaacgcataaagaacagctgcaatggtaagcatatataagaaataaaaattacttattgcgctgattacaatcattaaaataaacaaataaggtctcttaccttttaaaacgtgttcaatgccaagtaaaattaaaggtaaatatatcataggatttacaaaaaaaggatgtcttatagatgcaaacaaagcatatccacaaaaaacatatcctaacgcacctaatattgaaggtatctttttctgcttaaaattaaaacaaaataaaataaaaaataaacctgatagatataatctaagtataacaagaaaagaatacatatatgctgtatatttttctggagtgaatatataaaaaatacttaatggatcaccaaaagcataataatttaatgttgtaaaaatatctagtccagtaccgatagttaaatcccacatgggaattataagttcgtgattaaaaatcaaattttttattatatcccttacataattaccaaaaaacatagctgaagaataatgctgaacatatccgtcattttcccaaacaaaagacttcccttgataaataaacgtaaaaaaaacaaataaagaaataactgtgaacaatatactataaataatataccattttttgtaccaaacctcattatttttagaatttttctttttatcttcttttactatttttgcgttatcatcttttttttctttatttttaaatacaaatttagtaaagaagtaatttaatattactactattacagctactgcaattttaactatgccatcatttaacttaatcccttttatggtaaagttctctaccttgtcttcttttaactcatttacatatttataataatcatccataggctgacatattacttttaaatccgagaagctataatttccctttttagtaaacttaatatgtatatcatacttcccgtttttaaaataacctaaattatataaataattatttttaccaataaaataagtatttttacttgtagaaattccataagttttgtaatatgtttcttcatcatttatttttatttttataacagaagtcgttgctggaacgtataaaagattatctaccttatattttaattcttcacttttatatttaaattttttattactttcaattttatcattagaaaacagttcaaaatcatcaattgaaagataacattcactatttctgacattttttaaatgaataactatttctgagtttgcttctttaactaaaatacccttatcagttattttaattttctcttcttcatatttcccttctttcataatatcttctaaactcatcaatgtttttgaagaagtttttggattttggggagtaataaagtcgctttcgcttaaataaacgctttgaagcattgcatactctctgtcgttttcttttaacgaattaaaaatatttttgtcaataacggaatcataagtataaaacaactctaacggatttatattttcatacacactgttatttttatatctttttataagtttataatctttatatatatcaacttttctattattttttgaaatatagtattttattgattttaattcattgctgataatacgattatcatatccttgattgcttgaaaagcttacattccctaatgctccaatagcaaaaagataatctaaatcactcttatttctaacactataaaaacatgaaactccatttatatcatttaatacaccaagattgactttattattttttgattcagtgttatcaacatcaactctatatatattgtatttatcatgtttctttataaatttaaattccttttgttttgttttgtttattaaatcattatatgttttaaactgatcagattgcttttataagccccaaaattattttatttattttcccgggctttgtgttattttattcagcagttcttggaataatatatttaatatcatattttcaaaataagaaaacacatacaccacattcaacaatattattaataaaatccatattcttttttacaatatctatactcgttattacaatgaatttttattataagacgtttataataacaaaattagtaggcttatatttgatattttacggtataaccatatttacagattttatcgatgaggaaataccaaaatcatatgcaaataaaatgattaggaaaatatcaataagacttcctgttttatttacaatgggtattctaaaaaaaacactaacaaaaattacaaattacttgaatagtggagaaaacaaaaacgattcaatttataaaaaaacagatttagaacctaacttagaagtcttaattcatgtaaaagaaactggggcaggtatattcggccacatggatatatactataagggatttgtcatatcatatggtaactacgattatgctacatacagactatttgattctataggagaaggagtaatattttttataaaaggaaaagaggactatataaaattttgtaataaatatcatgaaaaaactatatttgattttggacttaacttaacagatgaacaaatgaaaaaagttgaagaaaaaataaatgagcatatcaggaattcatatccatggctatctccaaaagatttttacaaaaattcaaataaaaaatttgatgattatgcaagccaactagcaagggaaacaaacattaaatttagaaaaattaaaagaggtagatttaaaaattattttactttttatactaattgtgtaaaattcgcagatactattttaggacaaacaggaattgatattttaaatttaaatggaattttatctccgggatcatattataactattttgaaagagaatataaaagaaataatagtattgtaataacaaaaacagcatatcaccc

(The sequence listing continues in the following parts.)

What is claimed is:

1. A method of treating inflammatory bowel disease in a subject comprising: administering to said subject a therapeutic composition comprising a bacterial community consisting essentially of: a *Bacteroides dorei* strain, wherein said *Bacteroides dorei* strain is represented by SEQ ID NO: 4; a *Bacteroides fragilis* strain, wherein said *Bacteroides fragilis* strain is represented by SEQ ID NO: 5; a *Bacteroides ovatus* strain, wherein said *Bacteroides ovatus* strain is represented by SEQ ID NO: 7; a *Bacteroides thetaiotaomicron* strain, wherein said *Bacteroides thetaiotaomicron* strain is represented by SEQ ID NO: 10; a *Bifidobacterium adolescentis* strain, wherein said *Bifidobacterium adolescentis* strain comprising SEQ ID NO: 17; a first *Bifidobacterium longum* strain, wherein said first *Bifidobacterium longum* strain is represented by SEQ ID NO: 23; a second Bifidobacterium longum strain, wherein said second *Bifidobacterium longum* strain is represented by SEQ ID NO: 24; a *Bifidobacterium pseudocatenulatum* strain, wherein said *Bifidobacterium pseudocatenulatum* strain is represented by SEQ ID NO: 27; a *Butyricicoccus* p. strain, wherein said *Butyricicoccus* sp. strain is represented by SEQ ID NO: 29; a *Clostridium* sp. strain, wherein said *Clostridium* sp. strain is represented by SEQ ID NO: 34; a *Collinsella aerofaciens* strain, wherein said *Collinsella aerofaciens* strain is represented by SEQ ID NO: 36; a Escherichia coli strain, wherein said Escherichia coli strain is represented by SEQ ID NO: 43; a *Lactobacillus casei* strain, wherein said *Lactobacillus casei* strain is represented by SEQ ID NO: 47; a *Parabacteroides distasonis* strain, wherein said *Parabacteroides distasonis* strain is represented by SEQ ID NO: 50; and a *Ruminococcus torques* strain, wherein said *Ruminococcus torques* strain is represented by SEQ ID NO: 55.

2. The method of claim 1, wherein the therapeutic composition comprises a: vaccine, adjuvant, biological composition, pharmaceutical composition, probiotic, food, beverage, fecal transplant, bacterial composition, or a reagent used in an animal model, or a combination thereof.

3. A method of treating a disease in a subject by administering a therapeutic composition that stimulates RORyt⁺ Treg cell production in said subject, wherein said therapeutic composition comprises a bacterial community consisting essentially of: a *Bacteroides dorei* strain, wherein said *acteroides dorei* strain is represented by SEQ ID NO: 4; a Bacteroides fragilis strain, wherein said *Bacteroides fragilis* strain is represented by SEQ ID NO: 5; a *Bacteroides ovatus* strain, wherein said *Bacteroides ovatus* strain is represented by SEQ ID NO: 7; a *Bacteroides thetaiotaomicron* strain, wherein said *Bacteroides thetaiotaomicron* strain is represented by SEQ ID NO: 10; a *Bifidobacterium adolescentis* strain, wherein said *Bifidobacterium adolescentis* strain comprising SEQ ID NO: 17; a first *Bifidobacterium longum* strain, wherein said first *Bifidobacterium longum* strain is represented by SEQ ID NO: 23; a second *Bifidobacterium longum* strain, wherein said second *Bifidobacterium longum* strain is represented by SEQ ID NO: 24; a *Bifidobacterium pseudocatenulatum* strain, wherein said *Bifidobacterium pseudocatenulatum* strain is represented by SEQ ID NO: 27; a *Butyricicoccus* sp. strain, wherein said *Butyricicoccus* sp. strain is represented by SEQ ID NO: 29; a *Clostridium* sp. strain, wherein said *Clostridium* sp. strain is represented by SEQ ID NO: 34; a *Collinsella aerofaciens* strain, wherein said *Collinsella aerofaciens* strain is represented by SEQ ID NO: 36; a *Escherichia coli* strain, wherein said Escherichia coli strain is represented by SEQ ID NO: 43; a Lactobacillus casei strain, wherein said *Lactobacillus casei* strain is represented by SEQ ID NO: 47; a *Parabacteroides distasonis* strain, wherein said *Parabacteroides distasonis* strain is represented by SEQ ID NO: 50; and a Ruminococcus torques strain, wherein said *Ruminococcus torques* strain is represented by SEQ ID NO: 55.

4. The method of claim 3, wherein the disease is inflammatory bowel disease and the method comprises administering to the gastrointestinal tract (GI) of the subject said therapeutic composition.

5. The method of claim 3, wherein the therapeutic composition comprises a: vaccine, adjuvant, biological composition, pharmaceutical composition, probiotic, food, beverage, fecal transplant, bacterial composition, or a reagent used in an animal model, or a combination thereof.

6. The method of claim 4, wherein said therapeutic composition comprises a: vaccine, adjuvant, biological composition, pharmaceutical composition, probiotic, food, beverage, fecal transplant, bacterial composition, or a reagent used in an animal model, or a combination thereof.

* * * * *